(12) United States Patent
Lorens et al.

(10) Patent No.: US 7,485,414 B2
(45) Date of Patent: Feb. 3, 2009

(54) MODULATORS OF ANGIOGENESIS

(75) Inventors: James B. Lorens, Portola Valley, CA (US); Weiduan Xu, San Francisco, CA (US); Jakob Bogenberger, San Francisco, CA (US); Sacha Holland, San Francisco, CA (US)

(73) Assignee: Rigel Pharmaceuticals, Inc., South San Francisco, CA (US)

( * ) Notice: Subject to any disclaimer, the term of this patent is extended or adjusted under 35 U.S.C. 154(b) by 0 days.

(21) Appl. No.: 10/231,956

(22) Filed: Aug. 30, 2002

(65) Prior Publication Data

US 2004/0053233 A1 Mar. 18, 2004

(51) Int. Cl.
*C12Q 1/00* (2006.01)
*C12Q 1/68* (2006.01)
*G01N 33/53* (2006.01)
*G01N 33/567* (2006.01)
*C12N 5/00* (2006.01)

(52) U.S. Cl. ................ 435/4; 435/6; 435/7.1; 435/7.2; 435/7.21; 435/325; 435/375

(58) Field of Classification Search .............. 435/4, 435/6, 7.1, 69.1, 320.1, 325, 375, 455; 536/23.1, 536/23.5

See application file for complete search history.

(56) References Cited

FOREIGN PATENT DOCUMENTS

WO PCT/US2003/027523 9/2003

OTHER PUBLICATIONS

Molema et al. Pharmacol Rev. 52(2):237-68, 2000.*
Cho et al J Biol Chem, 274(52):37335-37339, 1999.*
Brooks et al., Science 264:569-571 (1994).
Tang et al., J. Cell Sci. 108:2629-2644 (1995).
Klemke et al., J. Cell Biol. 140:961-972 (1998).
Cho et al., J. Biol. Chem. 52:37335-37339 (1999).
Leonard et al., Biochem. J. 347:719-724 (2000).
Paulhe et al., J. Biol. Chem. 276:41832-41840 (2001).
Maeshima et al., J. Biol. Chem. 276:31959-31968 (2001).
Schor et al., Chemotoxis and Chemokinesis in 3D Macromolecular Matrices, in Angiogenesis Protocols, Murray ed., Human Press, Totowa New Jersey (2001).
Otsuki et al., GenBank Accession No. NP_037534.
Otsuki et al., GenBank Accession No. MN_013402.
Alessi et al., Molecular targeting of angiogenesis Biochimica et Biophysica Acta, Mar. 2004, pp. 39-49, vol. 1654.
Database GenEMbl on GenCore AN:BC025358, Nov. 2003, Strausberg RL et al. *Homo sapiens* ATP-binding cassette, sub family D (ALD), member 1, mRNA (cDNA clone MGC 39449 Image: 4907640).

* cited by examiner

*Primary Examiner*—Sumesh Kaushal
(74) *Attorney, Agent, or Firm*—Klarquist Sparkman, LLP

(57) ABSTRACT

The present invention relates to regulation of angiogenesis. More particularly, the present invention is directed to nucleic acids encoding "angiogenesis regulatory proteins and nucleic acids" which are involved in modulation of angiogenesis. The invention further relates to methods for identifying and using agents, including small organic molecules, antibodies, peptides, cyclic peptides, nucleic acids, antisense nucleic acids, RNAi, and ribozymes, that modulate angiogenesis via modulation of angiogenesis regulatory proteins and nucleic acids; as well as to the use of expression profiles and compositions in diagnosis and therapy of diseases related to angiogenesis.

18 Claims, 2 Drawing Sheets

MODULATORS OF ANGIOGENESIS

CROSS-REFERENCES TO RELATED APPLICATIONS

Not applicable.

STATEMENT AS TO RIGHTS TO INVENTIONS MADE UNDER FEDERALLY SPONSORED RESEARCH AND DEVELOPMENT

Not applicable.

FIELD OF THE INVENTION

The present invention relates to regulation of angiogenesis. More particularly, the present invention is directed to nucleic acids encoding "angiogenesis regulatory proteins and nucleic acids" which are involved in modulation of angiogenesis. The invention further relates to methods for identifying and using agents, including small organic molecules, antibodies, peptides, cyclic peptides, nucleic acids, antisense nucleic acids, RNAi, and ribozymes, that modulate angiogenesis via modulation of angiogenesis regulatory proteins and nucleic acids; as well as to the use of expression profiles and compositions in diagnosis and therapy of diseases related to angiogenesis.

BACKGROUND OF THE INVENTION

Angiogenesis is typically limited in a normal adult to the placenta, ovary, endometrium and sites of wound healing. However, angiogenesis, or its absence, plays an important role in the maintenance of a variety of pathological states. Some of these states are characterized by neovascularization, e.g., cancer, diabetic retinopathy, glaucoma, and age related macular degeneration. More specifically, pathological states characterized by neovascularization include lymphoma, hematologic cancers, melanoma, breast cancer, lung cancer, prostate cancer, colan cancer, ovarian cancer, liver cancer, Kaposi's sarcoma, metastatic disease, rheumatoid arthritis, psoriasis, and benign proliferative disorders including hemangiomas. Others, e.g., stroke, infertility, heart disease, ulcers, delayed wound healing, and scleroderma, are diseases of angiogenic insufficiency. Therefore, there is a need to identify nucleic acids encoding proteins involved in the regulation of angiogenesis, to identify, e.g., modulators of angiogenesis, as well as new therapeutic and diagnostic applications.

BRIEF SUMMARY OF THE INVENTION

The present application identifies, for the first time, a number of proteins and DNA molecules involved in regulation of angiogenesis, e.g., angiogenesis regulatory proteins and DNA molecules. The invention further relates to methods for identifying and using agents, including small organic molecules, antibodies, peptides, cyclic peptides, nucleic acids, antisense nucleic acids, RNAi, and ribozymes, that modulate angiogenesis via modulation of angiogenesis regulatory proteins and DNA molecules; as well as to the use of expression profiles and compositions in diagnosis and therapy of diseases related to insufficient or increased angiogenesis.

In one aspect, the present invention provides a method for identifying a compound that modulates angiogenesis, the method comprising the steps of:

(i) contacting the compound with an angiogenesis regulatory nucleic acid, or an angiogenesis regulatory polypeptide or a fragment thereof encoded by a nucleic acid, wherein the nucleic acid hybridizes under stringent conditions to a second nucleic acid comprising a nucleotide sequence selected from the group consisting of SEQ ID NO:3, SEQ ID NO:32, SEQ ID NO:43, SEQ ID NO:57, SEQ ID NO:63, SEQ ID NO:68, SEQ ID NO:70, SEQ ID NO:76, SEQ ID NO:81, SEQ ID NO:86, SEQ ID NO:89, SEQ ID NO:120, SEQ ID NO:128, SEQ ID NO:139, SEQ ID NO:153, SEQ ID NO:163, SEQ ID NO:165, SEQ ID NO:169, SEQ ID NO:171, SEQ ID NO:173, SEQ ID NO:175, SEQ ID NO:183, SEQ ID NO:202, SEQ ID NO:210, SEQ ID NO:218, SEQ ID NO:227, SEQ ID NO:232, SEQ ID NO:248, SEQ ID NO:274, SEQ ID NO:285, SEQ ID NO:286, SEQ ID NO:297, SEQ ID NO:307, SEQ ID NO:308, SEQ ID NO:317, SEQ ID NO:318, SEQ ID NO:320, SEQ ID NO:323, SEQ ID NO:324, SEQ ID NO:329, SEQ ID NO:330, SEQ ID NO:340, SEQ ID NO:351, SEQ ID NO:365, SEQ ID NO:377, SEQ ID NO:384, SEQ ID NO:406, SEQ ID NO:408, SEQ ID NO:419, SEQ ID NO:421, SEQ ID NO:428, SEQ ID NO:437, SEQ ID NO:439 SEQ ID NO:445, SEQ ID NO:456, SEQ ID NO:462, SEQ ID NO:481, SEQ ID NO:484, SEQ ID NO:493, SEQ ID NO:496, SEQ ID NO:498, and SEQ ID NO:519; and (ii) determining the functional effect of the compound upon the nucleic acid or polypeptide.

In one embodiment, the functional effect is determined in vitro. In another embodiment, the functional effect is a physical effect. In another embodiment, the functional effect is determined by measuring ligand or substrate binding to the polypeptide. In another embodiment, the functional effect is a chemical effect. In another embodiment, the functional effect is determined by measuring an enzymatic activity.

In one embodiment, the polypeptide is expressed in a eukaryotic host cell. In a further embodiment, the functional effect is a physical effect. In another embodiment, the functional effect is determined by measuring ligand or substrate binding to the polypeptide. In a further embodiment, the functional effect is a chemical or phenotypic effect. In another embodiment, the functional effect is determined by measuring an enzymatic activity. In another embodiment, the host cell is an endothelial cell. In a further embodiment, the functional effect is determined by measuring $\alpha v \beta 3$ expression or haptotaxis, or chemotaxis.

In one embodiment, modulation is inhibition of angiogenesis.

In one embodiment, the polypeptide is recombinant. In another embodiment, the nucleic acid comprises a nucleotide sequence selected from the group consisting of SEQ ID NO:3, SEQ ID NO:32, SEQ ID NO:43, SEQ ID NO:57, SEQ ID NO:63, SEQ ID NO:68, SEQ ID NO:70, SEQ ID NO:76, SEQ ID NO:81, SEQ ID NO:86, SEQ ID NO:89, SEQ ID NO:120, SEQ ID NO:128, SEQ ID NO:139, SEQ ID NO:153, SEQ ID NO:163, SEQ ID NO:165, SEQ ID NO:169, SEQ ID NO:171, SEQ ID NO:173, SEQ ID NO:175, SEQ ID NO:183, SEQ ID NO:202, SEQ ID NO:210, SEQ ID NO:218, SEQ ID NO:227, SEQ ID NO:232, SEQ ID NO:248, SEQ ID NO:274, SEQ ID NO:285, SEQ ID NO:286, SEQ ID NO:297, SEQ ID NO:307, SEQ ID NO:308, SEQ ID NO:317, SEQ ID NO:318, SEQ ID NO:320, SEQ ID NO:323, SEQ ID NO:324, SEQ ID NO:329, SEQ ID NO:330, SEQ ID NO:340, SEQ ID NO:351, SEQ ID NO:365, SEQ ID NO:377, SEQ ID NO:384, SEQ ID NO:406, SEQ ID NO:408, SEQ ID NO:419, SEQ ID NO:421, SEQ ID NO:428, SEQ ID NO:437, SEQ ID NO:439 SEQ ID NO:445, SEQ ID NO:456, SEQ ID NO:462, SEQ ID NO:481, SEQ ID NO:484, SEQ ID NO:493, SEQ ID NO:496, SEQ ID NO:498, and SEQ ID NO:519.

In another embodiment, the polypeptide comprises a sequence selected from the group consisting of SEQ ID NO:4, SEQ ID NO:33, SEQ ID NO:44, SEQ ID NO:58, SEQ ID NO:64, SEQ ID NO:69, SEQ ID NO:71, SEQ ID NO:77, SEQ ID NO:82, SEQ ID NO:87, SEQ ID NO:90, SEQ ID NO:121, SEQ ID NO:129, SEQ ID NO:140, SEQ ID NO:154, SEQ ID NO:164, SEQ ID NO:170, SEQ ID NO:172, SEQ ID NO:174, SEQ ID NO:176, SEQ ID NO:184, SEQ ID NO:203, SEQ ID NO:287, SEQ ID NO:298, SEQ ID NO:309, SEQ ID NO:319, SEQ ID NO:325, SEQ ID NO:331, SEQ ID NO:341, SEQ ID NO:352, SEQ ID NO:366, SEQ ID NO:378, SEQ ID NO:385, SEQ ID NO:407, SEQ ID NO:409, SEQ ID NO:420, SEQ ID NO:429, SEQ ID NO:438, SEQ ID NO:440, SEQ ID NO:446, SEQ ID NO:457, SEQ ID NO:463, SEQ ID NO:482, SEQ ID NO:485, SEQ ID NO:494, SEQ ID NO:497, SEQ ID NO:499, and SEQ ID NO:520.

In one embodiment, the compound is an antibody, an antisense molecule, a small organic molecule, or a peptide.

In another aspect, the present invention provides a method for identifying a compound that modulates angiogenesis, the method comprising the steps of (i) contacting the compound with a nucleic acid, or a polypeptide or a fragment thereof encoded by a nucleic acid, wherein the nucleic acid hybridizes under stringent conditions to a second nucleic acid comprising a nucleotide sequence selected from the group consisting of SEQ ID NO:3, SEQ ID NO:32, SEQ ID NO:43, SEQ ID NO:57, SEQ ID NO:63, SEQ ID NO:68, SEQ ID NO:70, SEQ ID NO:76, SEQ ID NO:81, SEQ ID NO:86, SEQ ID NO:89, SEQ ID NO:120, SEQ ID NO:128, SEQ ID NO:139, SEQ ID NO:153, SEQ ID NO:163, SEQ ID NO:165, SEQ ID NO:169, SEQ ID NO:171, SEQ ID NO:173, SEQ ID NO:175, SEQ ID NO:183, SEQ ID NO:202, SEQ ID NO:210, SEQ ID NO:218, SEQ ID NO:227, SEQ ID NO:232, SEQ ID NO:248, SEQ ID NO:274, SEQ ID NO:285, SEQ ID NO:286, SEQ ID NO:297, SEQ ID NO:307, SEQ ID NO:308, SEQ ID NO:317, SEQ ID NO:318, SEQ ID NO:320, SEQ ID NO:323, SEQ ID NO:324, SEQ ID NO:329, SEQ ID NO:330, SEQ ID NO:340, SEQ ID NO:351, SEQ ID NO:365, SEQ ID NO:377, SEQ ID NO:384, SEQ ID NO:406, SEQ ID NO:408, SEQ ID NO:419, SEQ ID NO:421, SEQ ID NO:428, SEQ ID NO:437, SEQ ID NO:439 SEQ ID NO:445, SEQ ID NO:456, SEQ ID NO:462, SEQ ID NO:481, SEQ ID NO:484, SEQ ID NO:493, SEQ ID NO:496, SEQ ID NO:498, and SEQ ID NO:519; (ii) determining the functional effect of the compound upon the nucleic acid or polypeptide; and (iii) expressing the nucleic acid or polypeptide in a cell, contacting the nucleic acid or polypeptide with the compound, and determining the phenotypic or chemical effect upon the cell.

In another aspect, the present invention provides a method of modulating angiogenesis in a subject, the method comprising the step of administering to the subject a therapeutically effective amount of a compound identified as a modulator of angiogenesis using the methods described herein. In one embodiment, the subject is a human. In a further embodiment, the compound is an antibody, an antisense molecule, a small organic molecule, a peptide, or an RNAi molecule. In another embodiment, the compound inhibits angiogenesis.

In another aspect, the present invention provides a method of modulating angiogenesis in a subject, the method comprising the step of administering to the subject a therapeutically effective amount of a polypeptide, the polypeptide encoded by a nucleic acid that hybridizes under stringent conditions to a second nucleic acid comprising a nucleotide sequence selected from the group consisting of SEQ ID NO:63, SEQ ID NO:76, SEQ ID NO:81, SEQ ID NO:86, SEQ ID NO:89, SEQ ID NO:120, SEQ ID NO:128, SEQ ID NO:165, SEQ ID NO:183, SEQ ID NO:202, SEQ ID NO:218, SEQ ID NO:232, SEQ ID NO:274, SEQ ID NO:285, SEQ ID NO:286, SEQ ID NO:297, SEQ ID NO:317, SEQ ID NO:318, SEQ ID NO:320, SEQ ID NO:323, SEQ ID NO:324, SEQ ID NO:340, SEQ ID NO:377, SEQ ID NO:384, SEQ ID NO:406, SEQ ID NO:408, SEQ ID NO:439 SEQ ID NO:445, SEQ ID NO:456, SEQ ID NO:481, SEQ ID NO:484, SEQ ID NO:493, SEQ ID NO:496, and SEQ ID NO:498.

In another aspect, the present invention provides a method of modulating angiogenesis in a subject, the method comprising the step of administering to the subject a therapeutically effective amount of a nucleic acid that hybridizes under stringent conditions to a second nucleic acid comprising a nucleotide sequence selected from the group consisting of SEQ ID NO:3, SEQ ID NO:32, SEQ ID NO:43, SEQ ID NO:57, SEQ ID NO:63, SEQ ID NO:68, SEQ ID NO:70, SEQ ID NO:76, SEQ ID NO:81, SEQ ID NO:86, SEQ ID NO:89, SEQ ID NO:120, SEQ ID NO:128, SEQ ID NO:139, SEQ ID NO:153, SEQ ID NO:163, SEQ ID NO:165, SEQ ID NO:169, SEQ ID NO:171, SEQ ID NO:173, SEQ ID NO:175, SEQ ID NO:183, SEQ ID NO:202, SEQ ID NO:210, SEQ ID NO:218, SEQ ID NO:227, SEQ ID NO:232, SEQ ID NO:248, SEQ ID NO:274, SEQ ID NO:285, SEQ ID NO:286, SEQ ID NO:297, SEQ ID NO:307, SEQ ID NO:308, SEQ ID NO:317, SEQ ID NO:318, SEQ ID NO:320, SEQ ID NO:323, SEQ ID NO:324, SEQ ID NO:329, SEQ ID NO:330, SEQ ID NO:340, SEQ ID NO:351, SEQ ID NO:365, SEQ ID NO:377, SEQ ID NO:384, SEQ ID NO:406, SEQ ID NO:408, SEQ ID NO:419, SEQ ID NO:421, SEQ ID NO:428, SEQ ID NO:437, SEQ ID NO:439 SEQ ID NO:445, SEQ ID NO:456, SEQ ID NO:462, SEQ ID NO:481, SEQ ID NO:484, SEQ ID NO:493, SEQ ID NO:496, SEQ ID NO:498, and SEQ ID NO:519.

In another aspect, the present invention provides the nucleic acid sequences of SEQ ID NO:165, SEQ ID NO:202, SEQ ID NO:210, SEQ ID NO:218, SEQ ID NO:227, SEQ ID NO:232, SEQ ID NO:248, SEQ ID NO:274, SEQ ID NO:285, SEQ ID NO:286, SEQ ID NO:297, SEQ ID NO:307, SEQ ID NO:308, SEQ ID NO:317, SEQ ID NO:318, SEQ ID NO:320, SEQ ID NO:323, SEQ ID NO:324, SEQ ID:329, and SEQ ID:330.

In another aspect, the present invention provides the amino acid sequences of SEQ ID NO:287, SEQ ID NO:298, SEQ ID NO:309, SEQ ID NO:319, SEQ ID NO:325, and SEQ ID NO:331.

DETAILED DESCRIPTION OF THE INVENTION

Introduction

Figure 1:
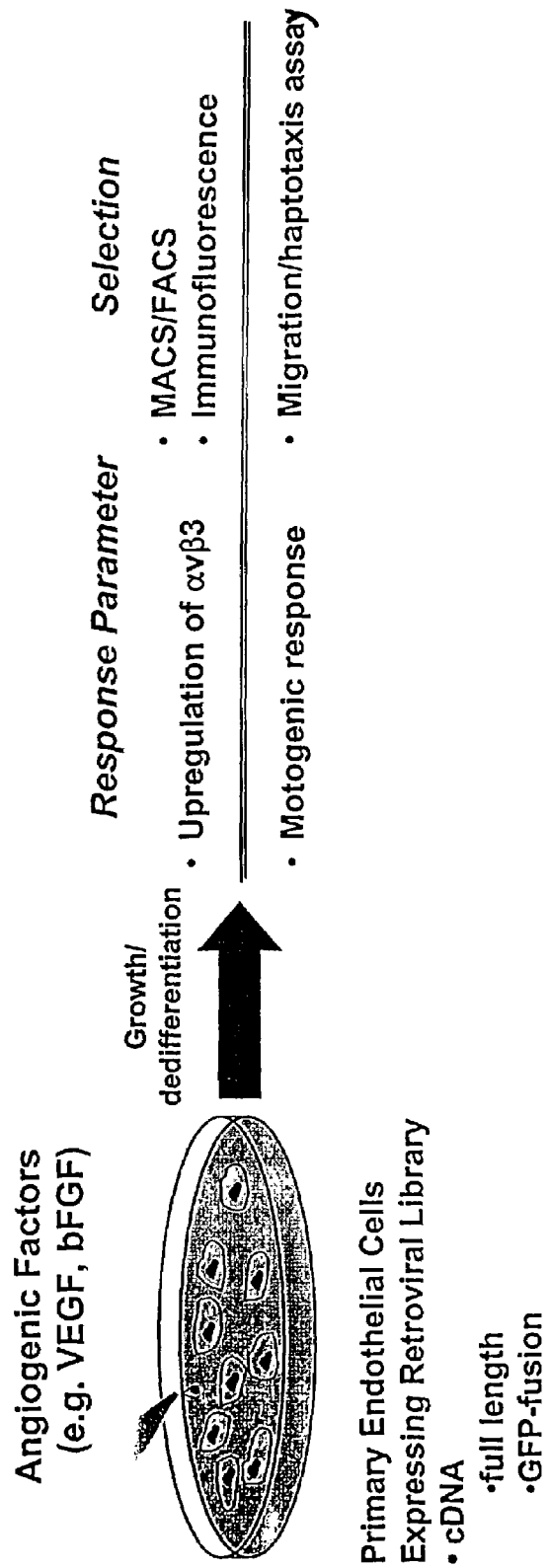
FIG. 1 provides a schematic diagram of an assay for modulators of angiogenesis.
Figure 2:
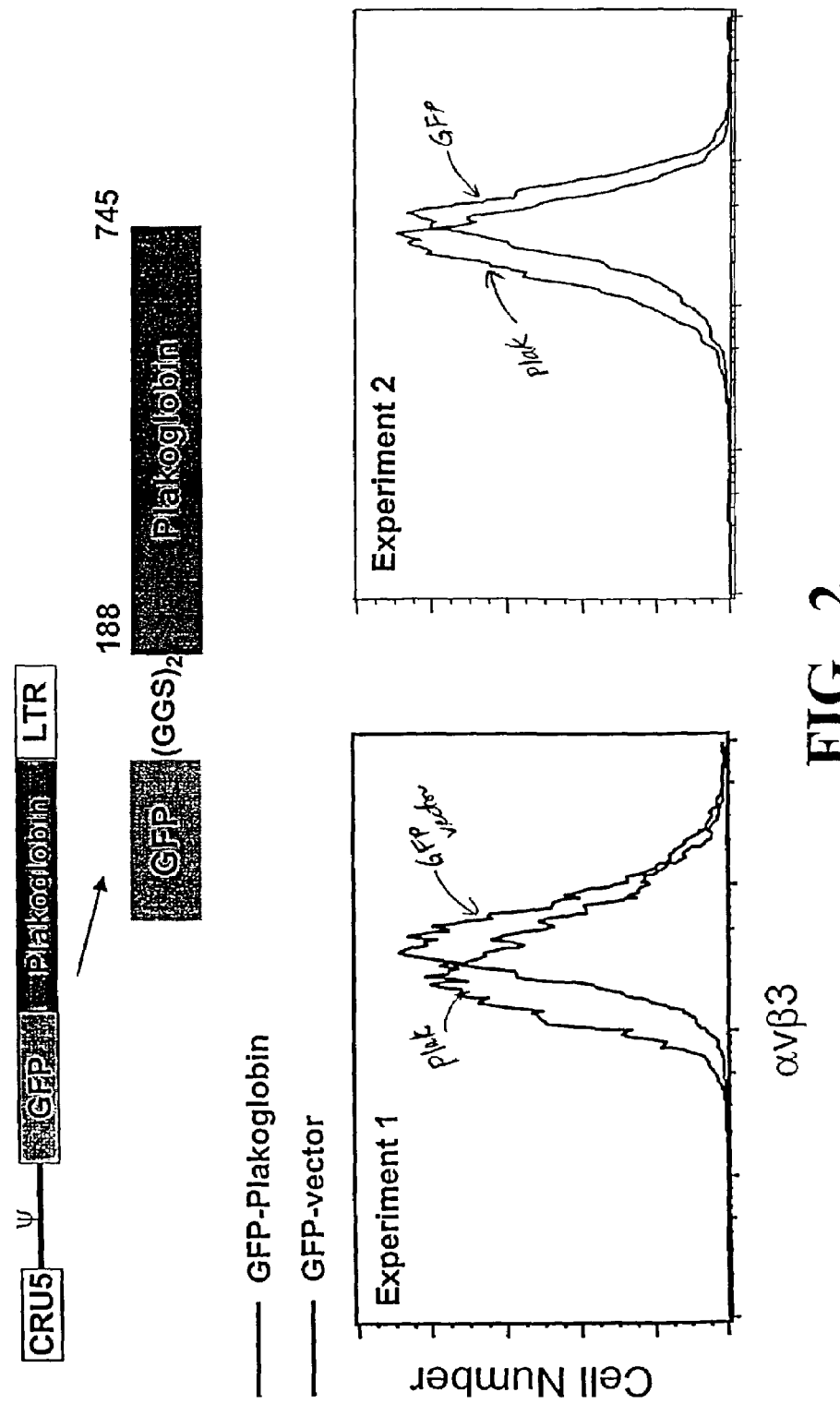
FIG. 2 provides results of an experiment demonstrating the effect of a plakoglobin-GFP fusion protein expression on levels of the cell surface marker αvβ3. Plakoglobin is an exemplar angiogenesis regulatory protein. Human umbilical vein endothelial (HUVEC) cells were transfected with a vector expressing the plakoglobin-GFP fusion protein or a control vector, expressing GFP only. Cells were incubated with APC-labeled antibodies directed against the cell surface marker αvβ3. The X-axis depicts cell number and the Y-axis depicts the amount of αvβ3-APC antibody derived fluorescence. Cells transfected with the plakoglobin-GFP fusion protein construct exhibit lower αvβ3 expression levels than control cells.

Using a functional assay, angiogenesis regulatory proteins and nucleic acids have been identified and cloned from a green fluorescent protein (GFP) fusion library. Primary endothelial cells were transduced with retroviral cDNA/GFP fusion libraries. Transduced cells were selected and assayed for alterations consistent with inhibition of angiogenesis, e.g. downregulation of cell surface expression of αvβ3 or downregulation of haptotaxis.

Using the screen described above, fifty-two proteins and/or DNA molecules were shown for the first time to regulate angiogenesis. Thirty-four of the proteins and/or DNA molecules are known, while fifteen of the proteins and/or DNA molecules are completely novel. However, for most of the proteins and/or DNA molecules, this is the first demonstration of a function in regulation of angiogenesis.

The ABC transporter is involved in peroxisome biogenesis. Relevant sequence data for the protein, nucleic acids encoding the ABC transporter, and related sequences include the nucleic acid accession number NM_000033, SEQ ID NO:3; protein accession number NP_000024, SEQ ID NO:4; a new sequence determination, SEQ ID NO:2; and the functional screen hit, SEQ ID NO:1. The protein has an ATP-binding domain. The gene encoding the ABC transporter is linked to a genetic disease, adrenoleukodystrophy (Mosser et al., *Nature* 361:682-3 (1993)). An antisense version of the ABC transporter gene, e.g., SEQ ID NO:1, was identified as a functional hit in the screen for modulators of angiogenesis.

PCB1, a poly (rC) binding protein functions as a translational co-activator and also binds 3' UTRs of RNA, most likely through KH domains, thereby regulating RNA stability. Relevant sequence data for the protein, nucleic acids encoding PCB 1, and related sequences include the nucleic acid accession number NM_006196, SEQ ID NO:32; protein accession number NP_006187, SEQ ID NO:33; and the functional screen hit, SEQ ID NO:531. An antisense version of the gene encoding PCB1 was identified as a functional hit in the screen for modulators of angiogenesis.

SLC1A5, an amino acid transporter, has ten transmembrane spanning segments. Relevant sequence data for the protein, nucleic acids encoding PCB 1, and related sequences include the nucleic acid accession number NM_005628, SEQ ID NO:43; protein accession number NP_005619, SEQ ID NO:44; and the functional screen hit, SEQ ID NO:34-42. An antisense version of the gene encoding SLC1A5 was identified as a functional hit in the screen for modulators of angiogenesis.

Chromobox homolog 6 is involved in chromatin regulation. Relevant sequence data for the protein, nucleic acids encoding chromobox homolog 6, and related sequences include the nucleic acid accession number NM_014292, SEQ ID NO:57; protein accession number NP_055107, SEQ ID NO:58; and the functional screen hit, SEQ ID NO:44-56. An antisense version of chromobox homolog 6 was identified as a functional hit in the screen for modulators of angiogenesis.

Cytochrome C oxidase subunit 1 is encoded by a mitochondrial gene and transfers electrons from cytochrome C to $O_2$ (Ingman et al., *Nature* 408:708-713 (2000); (Leninger, *Principles of Biochemistry* (1984); Stryer, *Biochemistry* (1995)) Relevant sequence data for the protein, nucleic acids encoding cytochrome C oxidase, and related sequences include the nucleic acid accession number NC_001807, SEQ ID NO:63; protein accession number NP_536845, SEQ ID NO:64; and the functional screen hit, SEQ ID NO:59-62. A sense version of the gene encoding cytochrome C oxidase, encoding a 21 amino acid peptide, was identified as a functional hit in the screen for modulators of angiogenesis.

Δ-5 fatty acid desaturase (FADSD5) introduces double bonds into a fatty acyl chain. The protein is involved in arachadonic acid synthesis and has a fatty acid desaturase domain and a heme-binding domain. Relevant sequence data for the protein, nucleic acids encoding Δ-5 fatty acid desaturase, and related sequences include the nucleic acid accession number NM_013402, SEQ ID NO:68; protein accession number NP_037534, SEQ ID NO:69; and the functional screen hit, SEQ ID NO:65-67. An antisense version of Δ-5 fatty acid desaturase gene was identified as a functional hit in the screen for modulators of angiogenesis.

The dynactin p27 subunit protein was shown to be an angiogenesis regulatory protein. The protein has an RGD domain. Relevant sequence data for the protein, and the nucleic acid encoding dynactin p27 subunit protein, include the nucleic acid accession number NC_006571, SEQ ID NO:70; and protein accession number NP_006562.1, SEQ ID NO:71. An antisense version of the gene encoding dynactin p27 subunit protein was identified as a functional hit in the screen for modulators of angiogenesis.

Elongation factor 1 alpha (EF1α) was shown to be involved in regulation of angiogenesis. Relevant sequence data for the protein, nucleic acids encoding EF1α, and related sequences include the nucleic acid accession number NC_001402, SEQ ID NO:76; protein accession number NP_001393, SEQ ID NO:77; and the functional screen hit, SEQ ID NO:72-75.

Elongation factor 4 gamma (e1F4γ) is a translation elongation factor. The protein also has a guanine nucleotide binding domain and a W2 domain. Relevant sequence data for the protein, nucleic acids encoding cytochrome C oxidase, and related sequences include the nucleic acid accession number NM_001418, SEQ ID NO:81; protein accession number NP_001409, SEQ ID NO:82; and the functional screen hit, SEQ ID NO:78-80. An antisense version of the e1F4γ gene was identified as a functional hit in the screen for modulators of angiogenesis. The antisense hit encodes a 21 amino acid peptide that may also be useful as a therapeutic or to modulate angiogenesis.

The filamin A protein binds integrin and regulates actin polymerization. Relevant sequence data for the protein, nucleic acids encoding filamin A, and related sequences include the nucleic acid accession number NM_001456, SEQ ID NO:86; protein accession number NP_001447, SEQ ID NO:87; and the functional screen hit, SEQ ID NO:83-85. A sense version of the filamin A gene was identified as a functional hit in the screen for modulators of angiogenesis.

Inactivation of the gene encoding the Gα13 protein causes a severe vascular phenotype in mice due to an inhibition of angiogenesis (vasculogenesis was apparent). This protein couples to the thrombin receptor. Thrombin and Gα13 protein activate Rho and tyrosine-phosphorylation of focal adhesion proteins FAK, Paxillin, and p130Cas. Gα13 also interacts with the cytoplasmic domain of adherins, leading to increased levels of b-catenin and transcriptional activation. Relevant sequence data for the protein, the nucleic acid encoding the Gα13 protein, and related sequences include the nucleic acid accession number NM_006572, SEQ ID NO:89; protein accession number NP_006563.1, SEQ ID NO:90; and the functional screen hit, SEQ ID NO:88. A sense version of the Gα13 gene was identified as a functional hit in the screen for modulators of angiogenesis.

The HOXB2 protein is a transcription factor. Relevant sequence data for the protein, nucleic acids encoding HOXB2, and related sequences include the nucleic acid accession number NM_002145, SEQ ID NO: 120; protein accession number NP_002136, SEQ ID NO:121; and the functional screen hit, SEQ ID NO:91-119. A sense version of the HOXB2 gene was identified as a functional hit in the screen for modulators of angiogenesis.

HSPA5, a member of the HSP70 family of proteins has a role in protein folding and assembly in the endoplasmic reticulum. Expression of the protein is glucose regulated. The protein has an ATPase domain which is fused in frame to GFP in the functional screen hit. Relevant sequence data for the protein, nucleic acids encoding HSPA5, and related sequences include the nucleic acid accession number NM_005347, SEQ ID NO:128; protein accession number NP_005338, SEQ ID NO:129; a new sequence determination, SEQ ID NO:127; and the functional screen hit, SEQ ID NO:122-126.

Interferon gamma receptor 1 (IFNγ1) is a cytokine receptor that induces antiangiogenic genes. Relevant sequence data for the protein, nucleic acids encoding IFNγ1, and related sequences include the nucleic acid accession number NM_000416, SEQ ID NO:139; protein accession number NP_000407, SEQ ID NO:140; and the functional screen hit, SEQ ID NO:130-138. An antisense version of the IFNγ1 gene was identified as a functional hit in the screen for modulators of angiogenesis.

Importin α4 (karyopherin α3) is a subunit of the nuclear localization signal receptor. Relevant sequence data for the protein, nucleic acids encoding importin α4, and related sequences include the nucleic acid accession number NM_002267, SEQ ID NO:153; protein accession number NP_002258.1, SEQ ID NO:154; and the functional screen hit, SEQ ID NO:141-152. An antisense version of the importin α4 gene was identified as a functional hit in the screen for modulators of angiogenesis.

The lysosomal pepstatin-insensitive protease (CLN2) is encoded by a gene associated with juvenile neuronal ceroid lipofuscinosis disease. Relevant sequence data for the protein, nucleic acids encoding CLN2, and related sequences include the nucleic acid accession number NM_000391, SEQ ID NO:163; protein accession number NP_000382, SEQ ID NO:164; and the functional screen hit, SEQ ID NO:155-162. An antisense version of the CLN2 gene was identified as a functional hit in the screen for modulators of angiogenesis.

A novel protein disulfide isomerase was shown to have a role in angiogenesis. Relevant sequence data for the nucleic acid encoding the novel protein disulfide isomerase, includes SEQ ID NO:165. An antisense version of gene encoding the novel protein disulfide isomerase was identified as a functional hit in the screen for modulators of angiogenesis. The antisense hit encodes a 45 or 32 amino acid peptide that may also be useful as a therapeutic or to modulate angiogenesis.

Microtubule-associated protein 4 (MAP4) binds tubulin and may link microtubules to other elements of the cytoskeleton. See e.g., Chapin & Bulinski, *J. Cell. Sci* 98:27-36 (1991); and Chapin et al., *Biochemistry* 34:2289-2301 (1995). Four isoforms of MAP4 are known. Relevant sequence data for the proteins, nucleic acids encoding MAP4 isoforms, and related sequences include the nucleic acid accession numbers NM_002375, NM_030884, NM_030885, and NM_030883; SEQ ID NOs:169, 171, 173, and 175; protein accession numbers NP_002366, NP_112146, NP_112147, and NP_112245; SEQ ID NOs: 170, 172, 174, and 176; and the functional screen hit, SEQ ID NO:166-168. An antisense version of MAP4 was identified as a functional hit in the screen for modulators of angiogenesis.

Neural precursor cell expressed developmentally down regulated 5 (Nedd5) is a septin GTPase. Relevant sequence data for the protein, nucleic acids encoding Nedd5, and related sequences include the nucleic acid accession number NM_004404, SEQ ID NO:183; protein accession number NM_004395, SEQ ID NO:184; and the functional screen hit, SEQ ID NO:177-182. A sense version of the Nedd5 gene was identified as a functional hit in the screen for modulators of angiogenesis.

A novel tyrosine/serine/threonine kinase was found to be involved in angiogenesis. The protein is also a breast cancer antigen. Relevant sequence data for the protein, nucleic acids encoding the novel kinase, and related sequences include the nucleic acid accession number NM_044379, SEQ ID NO:202; protein accession number XP_044379, SEQ ID NO:203; and the functional screen hit, SEQ ID NO:185-201. A sense version of the gene encoding the novel kinase was identified as a functional hit in the screen for modulators of angiogenesis.

A novel protein encoded by a gene on human chromosome 1 was found to be involved in angiogenesis. The chromosome 1 DNA sequence identified was previously identified as intron 1 of the JAK1 gene. Relevant sequence data for chromosome 1 DNA sequence include a new sequence determination, SEQ ID NO:210; and the functional screen hit, SEQ ID NO:204-209. The functional screen hit is believed to be in the antisense orientation.

A novel protein encoded by a gene on human chromosome 3 was found to be involved in angiogenesis. The chromosome 3 DNA sequence was previously identified as H41 exon 2/3 and part of intron 1. Relevant sequence data for the chromosome 3 DNA sequence include a new sequence determination, SEQ ID NO:218; and the functional screen hit, SEQ ID NO:211-217. The functional screen hit is in the sense orientation.

A novel protein encoded by a gene on human chromosome 17 was found to be involved in angiogenesis. Relevant sequence data for the chromosome 17 DNA sequence include a new sequence determination, SEQ ID NO:227; and the functional screen hit, SEQ ID NO:219-226. The functional screen hit is believed to be in the antisense orientation.

A novel protein encoded by a gene on human chromosome 8 was found to be involved in angiogenesis. Relevant sequence data for the chromosome 8 hit include a new sequence determination, SEQ ID NO:232; and the functional screen hit, SEQ ID NO:228231. The functional screen hit is believed to be in the antisense orientation or encodes a nine amino acid peptide that may also be useful as a therapeutic or to modulate angiogenesis.

A novel protein encoded by a gene on human chromosome 9 was found to be involved in angiogenesis. The chromosome 9 DNA sequence was previously identified as intronic DNA from the RXRa gene. Relevant sequence data for chromosome 9 hit include a new sequence determination, SEQ ID NO:248; and the functional screen hit, SEQ ID NO:233-247. The functional screen hit is believed to be in the antisense orientation.

A novel protein (1/226) that binds to PAK2 in a yeast two hybrid screen was found to be involved in angiogenesis. Relevant sequence data for the novel 1/226 hit include a new sequence determination, SEQ ID NO:274; and the functional screen hit, SEQ ID NO:249-273. The functional screen hit is in the sense orientation.

Another novel protein FLJ10688 contains fibronectin domains and binds to STAT-6 in a yeast two hybrid screen. Relevant sequence data for the protein, nucleic acids encoding FLJ10688, and related sequences include the nucleic acid accession number NM 018179, SEQ ID NO:286; protein accession number NP_060649, SEQ ID NO:287; a new sequence determination, SEQ ID NO:285; and the functional screen hit, SEQ ID NO:275-284. The functional screen hit is in the sense orientation.

Another novel protein KIAA0217 contains an RNA recognition motif. Relevant sequence data for the protein, nucleic acids encoding KIAA0217, and related sequences include the nucleic acid accession number XM_040265, SEQ ID NO:297; protein accession number NP_040265, SEQ ID NO:298; and the functional screen hit, SEQ ID NO:288-296. The functional screen hit is in the antisense orientation.

Another novel protein KIAA1583 is homologous to PDZ-RGS, which regulates Ephrin B signaling. Relevant sequence data for the protein, nucleic acids encoding KIAA1583, and related sequences include the nucleic acid accession number AB046803, SEQ ID NO:308; protein accession number BAB13409, SEQ ID NO:309; a new sequence determination, SEQ ID NO:307; and the functional screen hit, SEQ ID NO:299-306. The functional screen hit is in the antisense orientation.

A novel protein, KIAA1814, was found to be involved in angiogenesis. Relevant sequence data for functional screen hit include the nucleic acid accession number XM_046822, SEQ ID NO:318; protein accession number XP_046822, SEQ ID NO:319; a new sequence determination, SEQ ID NO:317; and the functional screen hit, SEQ ID NO:310-316. The functional screen hit is in the sense orientation.

A novel protein encoded by a gene on human chromosome 4 was found to be involved in angiogenesis. Relevant sequence data for functional screen hit include a new sequence determination, SEQ ID NO:320.

Another novel protein identified as an angiogenesis regulatory protein is related to a peroxidasin/melanoma antigen. The protein has peroxidase, vWF, Ig, and leucine rich domains. Relevant sequence data for the protein, nucleic acids encoding the novel protein, and related sequences include the nucleic acid accession number XM_056455, SEQ ID NO:324; protein accession number XP_056455, SEQ ID NO:325; a new sequence determination, SEQ ID NO:323; and the functional screen hit, SEQ ID NO:321-322. The functional screen hit is in the sense orientation comprising a fusion to the peroxidase domain.

Another novel protein identified herein as an angiogenesis regulatory protein is a novel WD40/SOCS box protein. Relevant sequence data for the protein, nucleic acids encoding the novel WD40/SOCS box protein, and related sequences include the nucleic acid accession number NM_018639, SEQ ID NO:330; protein accession number NP_061109, SEQ ID NO:331; a new sequence determination, SEQ ID NO:329; and the functional screen hit, SEQ ID NO:326-328. The functional screen hit is in the antisense orientation.

A Numb-like protein contains adapter and PTB domains and is involved in regulation of angiogenesis. Relevant sequence data for the protein, nucleic acids encoding the Numb-like protein, and related sequences include the nucleic acid accession number NM_004756, SEQ ID NO:340; protein accession number NP_004747, SEQ ID NO:341; and the functional screen hit, SEQ ID NO:332-339. The functional screen hit is in the sense orientation.

Protein p130CAS (Crk-associated substrate) was identified as an angiogenic regulatory protein. p130 CAS is an adapter protein and has SH3 domains. (Dorssers et al., *Mol. Endocrinol.* 7:870-878 (1993); Brinkman et al., *J. Natl. Cancer Inst.* 92:112-120 (2000)). Relevant sequence data for the protein, nucleic acids encoding FLJ10688, and related sequences include the nucleic acid accession number NM 014567, SEQ ID NO:351; protein accession number NP_055382, SEQ ID NO:352; and the functional screen hit, SEQ ID NO:342-350. The orientation of this functional screen hit is antisense.

Perlecan, a basement membrane component, was identified as an angiogenesis regulatory protein. (Nicole et al., *Nat. Genet.* 26:(4) 480-483 (2000)). Relevant sequence data for the protein, nucleic acids encoding perlecan, and related sequences include the nucleic acid accession number NM_005529, SEQ ID NO:365; protein accession number NP_005520, SEQ ID NO:366; and the functional screen hit, SEQ ID NO:353-364. The functional screen hit is in the antisense orientation.

The T cell activation protein PGR-1, was identified as an angiogenesis regulatory protein. Relevant sequence data for the protein, nucleic acids encoding PGR-1, and related sequences include the nucleic acid accession number NM_033296, SEQ ID NO:377; protein accession number NP_150638, SEQ ID NO:378; and the functional screen hit, SEQ ID NO:367-376. The functional screen hit is in the sense orientation.

Phosphoribosyl pyrophosphate synthetase associated protein 1 (PRPSAP1), was identified as an angiogenesis regulatory protein. PRPSAP1 regulates a nucleotide synthesis pathway. Relevant sequence data for the protein, nucleic acids encoding PRPSAP1, and related sequences include the nucleic acid accession number NM_002766, SEQ ID NO:384; protein accession number NP_002757, SEQ ID NO:385; and the functional screen hit, SEQ ID NO:379-383. The functional screen hit is in the sense orientation.

Plakoglobin, a member of the catenin family, was identified as an angiogenesis regulatory protein. Plakoglobin binds to E-cadherin, N-cadherin, and desmoglein proteins. Relevant sequence data for the protein, nucleic acids encoding plakoglobin, and related sequences include the nucleic acid accession numbers NM_002230, SEQ ID NO:406, NM_021991, SEQ ID NO:408; protein accession numbers NP_002221, SEQ ID NO:407, NP_068831, SEQ ID NO:409; and the functional screen hit, SEQ ID NO:386-405. Two functional screen hits were identified: one in the sense orientation, fused to GFP; and one in the antisense orientation.

Plasminogen activator inhibitor 1 (SERPINE1 or PAI-1) was identified as an angiogenesis regulatory protein. PAI-1 is a protease inhibitor. Relevant sequence data for the protein, nucleic acids encoding PAI-1, and related sequences include the nucleic acid accession number NM_000602, SEQ ID NO:419; protein accession number NP_000593, SEQ ID NO:420; and the functional screen hit, SEQ ID NO:410-418. The functional screen hit is in the antisense orientation.

Proteosomal subunit Y, an INFγ regulated proteosomal subunit, was identified as an angiogenesis regulatory protein. Relevant sequence data for proteosomal subunit Y includes the functional screen hit, SEQ ID NO:421. The functional screen hit is in the antisense orientation.

Rap2B was identified as an angiogenesis regulatory protein. Rap2B is a member of the RAS family of GTPases. Relevant sequence data for the protein, nucleic acids encoding Rap2B, and related sequences include the nucleic acid accession number XM_003032, SEQ ID NO:428; protein accession number XP_003032, SEQ ID NO:429; and the functional screen hit, SEQ ID NO:422-427. The functional screen hit is in the antisense orientation.

Semaphorin 3F was identified as an angiogenesis regulatory protein. Semaphorin 3F is a ligand for NP2. Relevant sequence data for the protein, nucleic acids encoding semaphorin 3F, and related sequences include the nucleic acid accession number U38276, SEQ ID NO:437; protein accession number AAB18276, SEQ ID NO:438; and the functional screen hit, SEQ ID NO:430-436. The functional screen hit is in the antisense orientation.

SPARC was identified as an angiogenesis regulatory protein. Relevant sequence data for the protein, nucleic acids encoding FLJ10688, and related sequences include the nucleic acid accession number NM_003118, SEQ ID NO:439; and protein accession number NP_003109, SEQ ID NO:440. ssDNA binding protein-1 was identified as an angiogenesis regulatory protein. Relevant sequence data for the protein, nucleic acids encoding FLJ10688, and related sequences include the nucleic acid accession number NM_018070, SEQ ID NO:445; protein accession number NP_060540, SEQ ID NO:446; and the functional screen hit, SEQ ID NO:441-444. The functional screen hit is in the sense orientation.

Sumo protease (SUSP-1) was identified as an angiogenesis regulatory protein. Relevant sequence data for the protein, nucleic acids encoding SUSP-1, and related sequences include the nucleic acid accession number NM_015571, SEQ ID NO:456; protein accession number NP_056386, SEQ ID NO:457; and the functional screen hit, SEQ ID NO:447-445. The functional screen hit is in the sense orientation and includes the 5' untranslated region of the gene.

Pantophysin, a synaptophysin homolog, was identified as an angiogenesis regulatory protein (Zhong et al., Biochim. Biophys. Acta 1129:235-238 (1992)). Pantophysin was previously shown to be involved in vesicle trafficking. Relevant sequence data for the protein, nucleic acids encoding pantophysin, and related sequences include the nucleic acid accession number NM_006754, SEQ ID NO:462; protein accession number NP_006745, SEQ ID NO:463; and the functional screen hit, SEQ ID NO:458-461. The functional screen hit is in the antisense orientation.

Thrombospondin, a known regulator of angiogenesis, was also identified as a sense hit fused to the laminin domain. Relevant sequence data for the protein, nucleic acids encoding thrombospondin, and related sequences include the nucleic acid accession number NM_0003246, SEQ ID NO:481; protein accession number NP_003237, SEQ ID NO:482; and the functional screen hit, SEQ ID NO:464-480.

Transgelin 2 was identified as an angiogenesis regulatory protein. Relevant sequence data for the protein, nucleic acids encoding transgelin 2, and related sequences include the nucleic acid accession number NM_003564, SEQ ID NO:484; protein accession number NP_003555, SEQ ID NO:485; and the functional screen hit, SEQ ID NO:483. The functional screen hit is in the sense orientation.

Vigilin was identified as an angiogenesis regulatory protein. Relevant sequence data for the protein, nucleic acids encoding vigilin, and related sequences include the nucleic acid accession number NM_005336, SEQ ID NO:493; protein accession number NP_005327, SEQ ID NO:494; and the functional screen hit, SEQ ID NO:486-492. The functional screen hit is in the sense orientation.

Vimentin was identified as an angiogenesis regulatory protein. Relevant sequence data for the protein, nucleic acids encoding vimentin, and related sequences include the nucleic acid accession number NM_003380, SEQ ID NO:496, XM_167414, SEQ ID NO:498; protein accession number NP_003371, SEQ ID NO:497, XP_167414, SEQ ID NO:499; and the functional screen hit, SEQ ID NO:495.

Vinexin (SCAM-1) was identified as an angiogenesis regulatory protein. SCAM-1 is an adaptor protein and has an SH3 domain. Relevant sequence data for the protein, nucleic acids encoding SCAM-1, and related sequences include the nucleic acid accession number NM_005775, SEQ ID NO:519; protein accession number NP_005766, SEQ ID NO:520; and the functional screen hit, SEQ ID NO:500-518. The functional screen hit is in the antisense orientation.

Some of the functional screen hits can be grouped together on the basis of other cellular functions. For example, plakoglobin, the Gα13 protein, and p130CAS protein all appear to function in cell adhesion. The Δ-5 fatty acid desaturase, the ALD protein (ABC transporter), cytochrome C oxidase, and the novel peroxidasin protein all may be important in arachadonic acid synthesis. The novel protein disulfide isomerase may be involved in collagen biosynthesis. Pantophysin, HSPA5, and dynactin p27, may all be involved in vesicle trafficking. Without wishing to be bound by theory, regulation of any of these cellular functions may influence the angiogenesis pathway. In addition, without wishing to be bound by theory, both the proteins and/or the nucleic acids identified in the assays are regulators of angiogenesis, e.g., by antisense activity, by overexpression of a functional protein, or as dominant negative inhibitors, or small peptide inhibitors.

Angiogenesis assays described herein reveal for the first time that expression of a nucleic acid molecule encoding the above described angiogenesis regulatory proteins exerted a negative effect on αvβ3 surface expression. In addition, endothelial cells expressing the sequences were strongly inhibited in their haptotactic response to vitronection, which is an indicator of an anti-angiogenic phenotype. Without wishing to be bound by theory, it appears that the angiogenesis regulatory proteins or fragments of those proteins, peptides derived from the proteins, or peptides and inhibitory DNA or RNA molecules derived from DNA encoding the proteins, provide an anti-angiogenic phenotype. Thus, in addition to their use in screens for modulators of angiogenesis, the angiogenesis regulatory proteins or fragments of those proteins, peptides derived from the proteins, or peptides and inhibitory DNA or RNA molecules derived from DNA encoding the proteins, can also be used as therapeutics for treatment of neovascularization or for treatment of angiogenic insufficiency.

The angiogenesis regulatory proteins, nucleic acids, and other members of the angiogenesis pathway therefore represent targets for the development of angiogenic drugs, preferably anti-angiogenic drugs, e.g., anti-angiogenic drugs for treatment of neovascularization. Neovascularization can be caused by pathologic states including cancer, diabetic retinopathy, glaucoma, age related macular degeneration, lymphoma, hematologic cancers, melanoma, breast cancer, lung cancer, prostate cancer, colan cancer, ovarian cancer, liver cancer, Kaposi's sarcoma, metastatic disease, rheumatoid arthritis, psoriasis, and benign proliferative disorders including hemangiomas. The angiogenesis regulatory proteins, nucleic acids, and other members of the angiogenesis pathway also represent targets for the development of angiogenic drugs for treatment of angiogenic insufficiency, e.g., stroke, infertility, heart disease, ulcers, delayed wound healing, and scleroderma, are diseases of angiogenic insufficiency. Modulators include small organic molecules, nucleic acids, peptides, cyclic peptides, antibodies, antisense molecules, RNAi molecules, and ribozymes. The nucleic acids and proteins of the invention are also useful for diagnostic applications, using, e.g., nucleic acid probes, oligonucleotides, and antibodies.

Definitions

By "disorder associated with angiogenesis" or "disease associated with angiogenesis" herein is meant a disease state which is marked by either an excess or a deficit of vessel development. Angiogenesis disorders associated with increased angiogenesis include, but are not limited to, cancer and proliferative diabetic retinopathy. Pathological states for which it may be desirable to increase angiogenesis include stroke, heart disease, infertility, ulcers, and scleredema. An increase in angiogenesis may also be desirable in transplantation or for artificial or in vitro growth of organs.

The terms "angiogenesis regulatory protein or nucleic acid" or a nucleic acid encoding "angiogenesis regulatory protein" refer to nucleic acid and polypeptide polymorphic variants, alleles, mutants, and interspecies homologs that: (1) have an amino acid sequence that has greater than about 60% amino acid sequence identity, 65%, 70%, 75%, 80%, 85%, 90%, preferably 91%, 92%, 93%, 94%, 95%, 96%, 97%, 98% or 99% or greater amino acid sequence identity, preferably over a region of over a region of at least about 25, 50, 100, 200, 500, 1000, or more amino acids, to a polypeptide encoded by a nucleic acid of SEQ ID NO:3, SEQ ID NO:32, SEQ ID NO:43, SEQ ID NO:57, SEQ ID NO:63, SEQ ID NO:68, SEQ ID NO:70, SEQ ID NO:76, SEQ ID NO:81, SEQ ID NO:86, SEQ ID NO:89, SEQ ID NO:120, SEQ ID NO:128, SEQ ID NO:139, SEQ ID NO:153, SEQ ID NO:163, SEQ ID NO:165, SEQ ID NO:169, SEQ ID NO:171, SEQ ID NO:173, SEQ ID NO:175, SEQ ID NO:183, SEQ ID NO:202, SEQ ID NO:210, SEQ ID NO:218, SEQ ID NO:227, SEQ ID NO:232, SEQ ID NO:248, SEQ ID NO:274, SEQ ID NO:285, SEQ ID NO:286, SEQ ID NO:297, SEQ ID NO:307, SEQ ID NO:308, SEQ ID NO:317, SEQ ID NO:318, SEQ ID NO:320, SEQ ID NO:323, SEQ ID NO:324, SEQ ID NO:329, SEQ ID NO:330, SEQ ID NO:340, SEQ ID NO:351, SEQ ID NO:365, SEQ ID NO:377, SEQ ID NO:384, SEQ ID NO:406, SEQ ID NO:408, SEQ ID NO:419, SEQ ID NO:421, SEQ ID NO:428, SEQ ID NO:437, SEQ ID NO:439 SEQ ID NO:445, SEQ ID NO:456, SEQ ID NO:462, SEQ ID NO:481, SEQ ID NO:484, SEQ ID NO:493, SEQ ID NO:496, SEQ ID NO:498, and SEQ ID NO:519, or an amino acid sequence of SEQ ID NO:4, SEQ ID NO:33, SEQ ID NO:44, SEQ ID NO:58, SEQ ID NO:64, SEQ ID NO:69, SEQ ID NO:71, SEQ ID NO:77, SEQ ID NO:82, SEQ ID NO:87, SEQ ID NO:90, SEQ ID NO:121, SEQ ID NO:129, SEQ ID NO:140, SEQ ID NO:154, SEQ ID NO:164, SEQ ID NO:170, SEQ ID NO:172, SEQ ID NO:174, SEQ ID NO:176, SEQ ID NO:184, SEQ ID NO:203, SEQ ID NO:287, SEQ ID NO:298, SEQ ID NO:309, SEQ ID NO:319, SEQ ID NO:325, SEQ ID NO:331, SEQ ID NO:341, SEQ ID NO:352, SEQ ID NO:366, SEQ ID NO:378, SEQ ID NO:385, SEQ ID NO:407, SEQ ID NO:409, SEQ ID NO:420, SEQ ID NO:429, SEQ ID NO:438, SEQ ID NO:440, SEQ ID NO:446, SEQ ID NO:457, SEQ ID NO:463, SEQ ID NO:482, SEQ ID NO:485, SEQ ID NO:494, SEQ ID NO:497, SEQ ID NO:499, and SEQ ID NO:520, or other sequences listed herein; (2) specifically bind to antibodies, e.g., polyclonal antibodies, raised against an immunogen comprising an amino acid sequence of SEQ ID NO:4, SEQ ID NO:33, SEQ ID NO:44, SEQ ID NO:58, SEQ ID NO:64, SEQ ID NO:69, SEQ ID NO:71, SEQ ID NO:77, SEQ ID NO:82, SEQ ID NO:87, SEQ ID NO:90, SEQ ID NO:121, SEQ ID NO:129, SEQ ID NO:140, SEQ ID NO:154, SEQ ID NO:164, SEQ ID NO:170, SEQ ID NO:172, SEQ ID NO:174, SEQ ID NO:176, SEQ ID NO:184, SEQ ID NO:203, SEQ ID NO:287, SEQ ID NO:298, SEQ ID NO:309, SEQ ID NO:319, SEQ ID NO:325, SEQ ID NO:331, SEQ ID NO:341, SEQ ID NO:352, SEQ ID NO:366, SEQ ID NO:378, SEQ ID NO:385, SEQ ID NO:407, SEQ ID NO:409, SEQ ID NO:420, SEQ ID NO:429, SEQ ID NO:438, SEQ ID NO:440, SEQ ID NO:446, SEQ ID NO:457, SEQ ID NO:463, SEQ ID NO:482, SEQ ID NO:485, SEQ ID NO:494, SEQ ID NO:497, SEQ ID NO:499, and SEQ ID NO:520, immunogenic fragments thereof, and conservatively modified variants thereof; (3) specifically hybridize under stringent hybridization conditions to a nucleic acid encoding SEQ ID NO:4, SEQ ID NO:33, SEQ ID NO:44, SEQ ID NO:58, SEQ ID NO:64, SEQ ID NO:69, SEQ ID NO:71, SEQ ID NO:77, SEQ ID NO:82, SEQ ID NO:87, SEQ ID NO:90, SEQ ID NO:121, SEQ ID NO:129, SEQ ID NO:140, SEQ ID NO:154, SEQ ID NO:164, SEQ ID NO:170, SEQ ID NO:172, SEQ ID NO:174, SEQ ID NO:176, SEQ ID NO:184, SEQ ID NO:203, SEQ ID NO:287, SEQ ID NO:298, SEQ ID NO:309, SEQ ID NO:319, SEQ ID NO:325, SEQ ID NO:331, SEQ ID NO:341, SEQ ID NO:352, SEQ ID NO:366, SEQ ID NO:378, SEQ ID NO:385, SEQ ID NO:407, SEQ ID NO:409, SEQ ID NO:420, SEQ ID NO:429, SEQ ID NO:438, SEQ ID NO:440, SEQ ID NO:446, SEQ ID NO:457, SEQ ID NO:463, SEQ ID NO:482, SEQ ID NO:485, SEQ ID NO:494, SEQ ID NO:497, SEQ ID NO:499, and SEQ ID NO:520., e.g., a nucleic acid sequence of SEQ ID NO:3, SEQ ID NO:32, SEQ ID NO:43, SEQ ID NO:57, SEQ ID NO:63, SEQ ID NO:68, SEQ ID NO:70, SEQ ID NO:76, SEQ ID NO:81, SEQ ID NO:86, SEQ ID NO:89, SEQ ID NO:120, SEQ ID NO:128, SEQ ID NO:139, SEQ ID NO:153, SEQ ID NO:163, SEQ ID NO:165, SEQ ID NO:169, SEQ ID NO:171, SEQ ID NO:173, SEQ ID NO:175, SEQ ID NO:183, SEQ ID NO:202, SEQ ID NO:210, SEQ ID NO:218, SEQ ID NO:227, SEQ ID NO:232, SEQ ID NO:248, SEQ ID NO:274, SEQ ID NO:285, SEQ ID NO:286, SEQ ID NO:297, SEQ ID NO:307, SEQ ID NO:308, SEQ ID NO:317, SEQ ID NO:318, SEQ ID NO:320, SEQ ID NO:323, SEQ ID NO:324, SEQ ID NO:329, SEQ ID NO:330, SEQ ID NO:340, SEQ ID NO:351, SEQ ID NO:365, SEQ ID NO:377, SEQ ID NO:384, SEQ ID NO:406, SEQ ID NO:408, SEQ ID NO:419, SEQ ID NO:421, SEQ ID NO:428, SEQ ID NO:437, SEQ ID NO:439 SEQ ID NO:445, SEQ ID NO:456, SEQ ID NO:462, SEQ ID NO:481, SEQ ID NO:484, SEQ ID NO:493, SEQ ID NO:496, SEQ ID NO:498, and SEQ ID NO:519 or its complement, and conservatively modified variants thereof; (4) have a nucleic acid sequence that has greater than about 95%, preferably greater than about 96%, 97%, 98%, 99%, or higher nucleotide sequence identity, preferably over a region of at least about 25, 50, 100, 200, 500, 1000, or more nucleotides, to SEQ ID NO:3, SEQ ID NO:32, SEQ ID NO:43, SEQ ID NO:57, SEQ ID NO:63, SEQ ID NO:68, SEQ ID NO:70, SEQ ID NO:76, SEQ ID NO:81, SEQ ID NO:86, SEQ ID NO:89, SEQ ID NO:120, SEQ ID NO:128, SEQ ID NO:139, SEQ ID NO:153, SEQ ID NO:163, SEQ ID NO:165, SEQ ID NO:169, SEQ ID NO:171, SEQ ID NO:173, SEQ ID NO:175, SEQ ID NO:183, SEQ ID NO:202, SEQ ID NO:210, SEQ ID NO:218, SEQ ID NO:227, SEQ ID NO:232, SEQ ID NO:248, SEQ ID NO:274, SEQ ID NO:285, SEQ ID NO:286, SEQ ID NO:297, SEQ ID NO:307, SEQ ID NO:308, SEQ ID NO:317, SEQ ID NO:318, SEQ ID NO:320, SEQ ID NO:323, SEQ ID NO:324, SEQ ID NO:329, SEQ ID NO:330, SEQ ID NO:340, SEQ ID NO:351, SEQ ID NO:365, SEQ ID NO:377, SEQ ID NO:384, SEQ ID NO:406, SEQ ID NO:408, SEQ ID NO:419, SEQ ID NO:421, SEQ ID NO:428, SEQ ID NO:437, SEQ ID NO:439 SEQ ID NO:445, SEQ ID NO:456, SEQ ID NO:462, SEQ ID NO:481, SEQ ID NO:484, SEQ ID NO:493, SEQ ID NO:496, SEQ ID NO:498, and SEQ ID NO:519, or the complement of any of those sequences. A polynucleotide or polypeptide sequence is typically from a mammal including, but not limited to, primate, e.g., human; rodent, e.g., rat, mouse, hamster; cow, pig, horse, sheep, or any mammal. The nucleic acids and proteins of the invention include both naturally occurring or recombinant molecules. When available, accession numbers for the human angiogenesis regulatory proteins and genes are provided.

The phrase "functional effects" in the context of assays for testing compounds that modulate activity of a angiogenesis regulatory proteins includes the determination of a parameter that is indirectly or directly under the influence of a angiogenesis regulatory protein polypeptide, e.g., a chemical or phenotypic effect such as loss-of angiogenesis phenotype represented by a change in expression of a cell surface marker, such as $\alpha v \beta 3$ integrin, or changes in cellular proliferation, especially endothelial cell proliferation; or enzymatic activity, or, e.g., a physical effect such as ligand binding or inhibition of ligand binding. A functional effect therefore includes ligand binding activity, the ability of cells to proliferate, expression in cells undergoing angiogenesis, and other characteristics of angiogenic cells. "Functional effects" include in vitro, in vivo, and ex vivo activities. Angiogenesis assays are described, e.g., in *Angiogenesis Protocols* (Murray, ed., 2001).

By "determining the functional effect" is meant assaying for a compound that increases or decreases a parameter that is indirectly or directly under the influence of a angiogenesis regulatory proteins, e.g., measuring physical and chemical or phenotypic effects. Such functional effects can be measured by any means known to those skilled in the art, e.g., changes in spectroscopic characteristics (e.g., fluorescence, absorbance, refractive index); hydrodynamic (e.g., shape), chromatographic; or solubility properties for the protein; measuring inducible markers or transcriptional activation of the angiogenesis protein; measuring changes in cell surface markers, e.g., $\alpha v \beta 3$ integrin; and measuring cellular proliferation, particularly endothelial cell proliferation. Functional effects can be measured using ligand binding assays, e.g., binding to antibodies or other molecules. Functional effects can be determined by measuring changes in enzymatic activity. Examples of enzymatic activities include, but are not limited to protein translation, electron transfer, fatty acid desaturase activity, protein disulfide isomerase activity, transcriptional activation activity, peroxidase activity, kinase activity, and proteolytic activity.

Determination of the functional effect of a compound on angiogenesis can also be performed using angiogenesis assays known to those of skill in the art such as $\alpha v \beta 3$ downregulation, VEGF-2 upregulation, endothelial cell tube formation assays; chemotaxis assays, haptotaxis assays; differentiation assays using matrigel or co-culture with smooth muscle cells, the chick CAM assay; the mouse corneal assay; and assays that assess vascularization of an implanted tumor. The functional effects can be evaluated by many means known to those skilled in the art, e.g., microscopy for quantitative or qualitative measures of alterations in morphological features, e.g., tube or blood vessel formation, measurement of changes in RNA or protein levels for angiogenesis-associated sequences, measurement of RNA stability, identification of downstream or reporter gene expression (CAT, luciferase, β-gal, GFP and the like), e.g., via chemiluminescence, fluorescence, colorimetric reactions, antibody binding, inducible markers, etc.

"Ligand" refers to a molecule that is specifically bound by a protein. An antibody is one example of a ligand. Other examples of ligands include RNA, cytochrome C, $O_2$, NADP or NADPH, heme, MHC molecules, an amino acid sequence comprising a nuclear localization signal, tubulin or other cytoskeletal proteins, the thrombin receptor, transcription factor 7, cadherins, and ssDNA.

"Substrate" refers to a molecule that binds to an enzyme and is part of a specific chemical reaction catalyzed by the enzyme. Substrates of angiogenesis regulatory proteins include ATP, fatty acids, GTP, $O_2$, arachadonic acids or its precursors, collagen, and protein molecules or peptides.

"Inhibitors," "activators," and "modulators" of angiogenesis regulatory protein polynucleotide and polypeptide sequences are used to refer to activating, inhibitory, or modulating molecules identified using in vitro and in vivo assays of angiogenesis regulatory protein polynucleotide and polypeptide sequences. Inihibitors are compounds that, e.g., bind to, partially or totally block activity, decrease, prevent, delay activation, inactivate, desensitize, or down regulate the activity or expression of angiogenesis regulatory proteins, e.g., antagonists. "Activators" are compounds that increase, open, activate, facilitate, enhance activation, sensitize, agonize, or up regulate angiogenesis regulatory proteins activity, e.g., agonists. Inhibitors, activators, or modulators also include genetically modified versions of angiogenesis regulatory proteins, e.g., versions with altered activity, as well as naturally occurring and synthetic ligands, antagonists, agonists, antibodies, peptides, cyclic peptides, nucleic acids, antisense molecules, ribozymes, RNAi, small organic molecules and the like. Such assays for inhibitors and activators include, e.g., expressing angiogenesis regulatory proteins in vitro, in cells, or cell extracts, applying putative modulator compounds, and then determining the functional effects on activity, as described above.

Samples or assays comprising angiogenesis regulatory proteins that are treated with a potential activator, inhibitor, or modulator are compared to control samples without the inhibitor, activator, or modulator to examine the extent of inhibition. Control samples (untreated with inhibitors) are assigned a relative protein activity value of 100%. Inhibition of angiogenesis regulatory protein is achieved when the activity value relative to the control is about 80%, preferably 50%, more preferably 25-0%. Activation of angiogenesis regulatory protein is achieved when the activity value relative to the control (untreated with activators) is 110%, more preferably 150%, more preferably 200-500% (i.e., two to five fold higher relative to the control), more preferably 1000-3000% higher.

The term "test compound" or "drug candidate" or "modulator" or grammatical equivalents as used herein describes any molecule, either naturally occurring or synthetic, e.g., protein, oligopeptide (e.g., from about 5 to about 25 amino acids in length, preferably from about 10 to 20 or 12 to 18 amino acids in length, preferably 12, 15, or 18 amino acids in length), small organic molecule, polysaccharide, lipid, fatty acid, polynucleotide, oligonucleotide, etc., to be tested for the capacity to directly or indirectly modulate angiogenesis. The test compound can be in the form of a library of test compounds, such as a combinatorial or randomized library that provides a sufficient range of diversity. Test compounds are optionally linked to a fusion partner, e.g., targeting compounds, rescue compounds, dimerization compounds, stabilizing compounds, addressable compounds, and other functional moieties. Conventionally, new chemical entities with useful properties are generated by identifying a test compound (called a "lead compound") with some desirable property or activity, e.g., inhibiting activity, creating variants of the lead compound, and evaluating the property and activity of those variant compounds. Often, high throughput screening (HTS) methods are employed for such an analysis.

A "small organic molecule" refers to an organic molecule, either naturally occurring or synthetic, that has a molecular weight of more than about 50 daltons and less than about 2500 daltons, preferably less than about 2000 daltons, preferably between about 100 to about 1000 daltons, more preferably between about 200 to about 500 daltons.

"RNAi molecule" or an "siRNA" refers to a nucleic acid that forms a double stranded RNA, which double stranded RNA has the ability to reduce or inhibit expression of a gene or target gene when the siRNA expressed in the same cell as the gene or target gene. "siRNA" thus refers to the double stranded RNA formed by the complementary strands. The complementary portions of the siRNA that hybridize to form the double stranded molecule typically have substantial or complete identity. In one embodiment, an siRNA refers to a nucleic acid that has substantial or complete identity to a target gene and forms a double stranded siRNA. The sequence of the siRNA can correspond to the full length target gene, or a subsequence thereof. Typically, the siRNA is at least about 15-50 nucleotides in length (e.g., each complementary sequence of the double stranded siRNA is 15-50 nucleotides in length, and the double stranded siRNA is about 15-50 base pairs in length, preferable about preferably about 20-30 base nucleotides, preferably about 20-25 nucleotides in length, e.g., 20, 21, 22, 23, 24, 25, 26, 27, 28, 29, or 30 nucleotides in length.

"Biological sample" include sections of tissues such as biopsy and autopsy samples, and frozen sections taken for histologic purposes. Such samples include blood, sputum, tissue, cultured cells, e.g., primary cultures, explants, and transformed cells, stool, urine, etc. A biological sample is typically obtained from a eukaryotic organism, most preferably a mammal such as a primate, e.g., chimpanzee or human; cow; dog; cat; a rodent, e.g., guinea pig, rat, mouse; rabbit; or a bird; reptile; or fish.

The terms "identical" or percent "identity," in the context of two or more nucleic acids or polypeptide sequences, refer to two or more sequences or subsequences that are the same or have a specified percentage of amino acid residues or nucleotides that are the same (i.e., about 70% identity, preferably 75%, 80%, 85%, 90%, 91%, 92%, 93%, 94%, 95%, 96%, 97%, 98%, 99%, or higher identity over a specified region (e.g., SEQ ID NO:1 or 2), when compared and aligned for maximum correspondence over a comparison window or designated region) as measured using a BLAST or BLAST 2.0 sequence comparison algorithms with default parameters described below, or by manual alignment and visual inspection (see, e.g., NCBI web site or the like). Such sequences are then said to be "substantially identical." This definition also refers to, or may be applied to, the compliment of a test sequence. The definition also includes sequences that have deletions and/or additions, as well as those that have substitutions. As described below, the preferred algorithms can account for gaps and the like. Preferably, identity exists over a region that is at least about 25 amino acids or nucleotides in length, or more preferably over a region that is 50-100 amino acids or nucleotides in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Preferably, default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Natl. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds. 1995 supplement)).

A preferred example of algorithm that is suitable for determining percent sequence identity and sequence similarity are the BLAST and BLAST 2.0 algorithms, which are described in Altschul et al., *Nuc. Acids Res.* 25:3389-3402 (1977) and Altschul et al., *J. Mol. Biol.* 215:403-410 (1990), respectively. BLAST and BLAST 2.0 are used, with the parameters described herein, to determine percent sequence identity for the nucleic acids and proteins of the invention. Software for performing BLAST analyses is publicly available through the National Center for Biotechnology Information (http://www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3, and expectation (E) of 10, and the BLOSUM62 scoring matrix (see Henikoff & Henikoff, Proc. Natl. Acad. Sci. USA 89:10915 (1989)) alignments (B) of 50, expectation (E) of 10, M=5, N=-4, and a comparison of both strands.

"Nucleic acid" refers to deoxyribonucleotides or ribonucleotides and polymers thereof in single- or double-stranded form, or complements thereof. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs). Nucleic acids also include complementary nucleic acids.

Unless otherwise indicated, a particular nucleic acid sequence also implicitly encompasses conservatively modified variants thereof (e.g., degenerate codon substitutions) and complementary sequences, as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.* 19:5081 (1991); Ohtsuka et al., *J. Biol. Chem.* 260:2605-2608 (1985); Rossolini et al., *Mol. Cell. Probes* 8:91-98 (1994)). The term nucleic acid is used interchangeably with gene, cDNA, mRNA, oligonucleotide, and polynucleotide.

A particular nucleic acid sequence also implicitly encompasses "splice variants." Similarly, a particular protein encoded by a nucleic acid implicitly encompasses any protein encoded by a splice variant of that nucleic acid. "Splice variants," as the name suggests, are products of alternative splicing of a gene. After transcription, an initial nucleic acid transcript may be spliced such that different (alternate) nucleic acid splice products encode different polypeptides. Mechanisms for the production of splice variants vary, but include alternate splicing of exons. Alternate polypeptides derived from the same nucleic acid by read-through transcription are also encompassed by this definition. Any products of a splicing reaction, including recombinant forms of the splice products, are included in this definition.

The terms "polypeptide," "peptide" and "protein" are used interchangeably herein to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymer.

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an at carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions in a manner similar to a naturally occurring amino acid.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

"Conservatively modified variants" applies to both amino acid and nucleic acid sequences. With respect to particular nucleic acid sequences, conservatively modified variants refers to those nucleic acids which encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein which encodes a polypeptide also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid which encodes a polypeptide is implicit in each described sequence with respect to the expression product, but not with respect to actual probe sequences.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the invention.

The following eight groups each contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, *Proteins* (1984)).

Macromolecular structures such as polypeptide structures can be described in terms of various levels of organization. For a general discussion of this organization, see, e.g., Alberts et al., *Molecular Biology of the Cell* ($3^{rd}$ ed., 1994) and Cantor and Schimmel, *Biophysical Chemistry Part I: The Conformation of Biological Macromolecules* (1980). "Primary structure" refers to the amino acid sequence of a particular peptide. "Secondary structure" refers to locally ordered, three dimensional structures within a polypeptide. These structures are commonly known as domains, e.g., transmembrane domains, pore domains, and cytoplasmic tail domains. Domains are portions of a polypeptide that form a compact unit of the polypeptide and are typically 15 to 350 amino acids long. Exemplary domains include domains with enzymatic activity, e.g., phosphatase domains, ligand binding domains, etc. Typical domains are made up of sections of lesser organization such as stretches of β-sheet and α-helices. "Tertiary structure" refers to the complete three dimensional structure of a polypeptide monomer. "Quaternary structure" refers to the three dimensional structure formed by the noncovalent association of independent tertiary units. Anisotropic terms are also known as energy terms.

A "label" or a "detectable moiety" is a composition detectable by spectroscopic, photochemical, biochemical, immunochemical, chemical, or other physical means. For example, useful labels include $^{32}P$, fluorescent dyes, electron-dense reagents, enzymes (e.g., as commonly used in an ELISA), biotin, digoxigenin, or haptens and proteins which can be made detectable, e.g., by incorporating a radiolabel into the peptide or used to detect antibodies specifically reactive with the peptide.

The term "recombinant" when used with reference, e.g., to a cell, or nucleic acid, protein, or vector, indicates that the cell, nucleic acid, protein or vector, has been modified by the introduction of a heterologous nucleic acid or protein or the alteration of a native nucleic acid or protein, or that the cell is derived from a cell so modified. Thus, for example, recombinant cells express genes that are not found within the native (non-recombinant) form of the cell or express native genes that are otherwise abnormally expressed, under expressed or not expressed at all.

The term "heterologous" when used with reference to portions of a nucleic acid indicates that the nucleic acid comprises two or more subsequences that are not found in the same relationship to each other in nature. For instance, the nucleic acid is typically recombinantly produced, having two or more sequences from unrelated genes arranged to make a new functional nucleic acid, e.g., a promoter from one source and a coding region from another source. Similarly, a heterologous protein indicates that the protein comprises two or more subsequences that are not found in the same relationship to each other in nature (e.g., a fusion protein).

The phrase "stringent hybridization conditions" refers to conditions under which a probe will hybridize to its target subsequence, typically in a complex mixture of nucleic acids, but to no other sequences. Stringent conditions are sequence-dependent and will be different in different circumstances. Longer sequences hybridize specifically at higher temperatures. An extensive guide to the hybridization of nucleic acids is found in Tijssen, *Techniques in Biochemistry and Molecular Biology—Hybridization with Nucleic Probes*, "Overview of principles of hybridization and the strategy of nucleic acid assays" (1993). Generally, stringent conditions are selected to be about 5-10° C. lower than the thermal melting point ($T_m$) for the specific sequence at a defined ionic strength pH. The $T_m$ is the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may also be achieved with the addition of destabilizing agents such as formamide. For selective or specific hybridization, a positive signal is at least two times background, preferably 10 times background hybridization. Exemplary stringent hybridization conditions can be as following: 50% formamide, 5×SSC, and 1% SDS, incubating at 42° C., or, 5×SSC, 1% SDS, incubating at 65° C., with wash in 0.2×SSC, and 0.1% SDS at 65° C.

Nucleic acids that do not hybridize to each other under stringent conditions are still substantially identical if the polypeptides which they encode are substantially identical. This occurs, for example, when a copy of a nucleic acid is created using the maximum codon degeneracy permitted by the genetic code. In such cases, the nucleic acids typically hybridize under moderately stringent hybridization conditions. Exemplary "moderately stringent hybridization conditions" include a hybridization in a buffer of 40% formamide, 1 M NaCl, 1% SDS at 37° C., and a wash in 1×SSC at 45° C. A positive hybridization is at least twice background. Those of ordinary skill will readily recognize that alternative hybridization and wash conditions can be utilized to provide conditions of similar stringency. Additional guidelines for determining hybridization parameters are provided in numerous reference, e.g., and *Current Protocols in Molecular Biology*, ed. Ausubel, et al.

For PCR, a temperature of about 36° C. is typical for low stringency amplification, although annealing temperatures may vary between about 32° C. and 48° C. depending on primer length. For high stringency PCR amplification, a temperature of about 62° C. is typical, although high stringency annealing temperatures can range from about 50° C. to about 65° C., depending on the primer length and specificity. Typical cycle conditions for both high and low stringency amplifications include a denaturation phase of 90° C.-95° C. for 30 sec-2 min., an annealing phase lasting 30 sec.-2 min., and an extension phase of about 72° C. for 1-2 min. Protocols and guidelines for low and high stringency amplification reactions are provided, e.g., in Innis et al. (1990) *PCR Protocols, A Guide to Methods and Applications*, Academic Press, Inc. N.Y.).

"Antibody" refers to a polypeptide comprising a framework region from an immunoglobulin gene or fragments thereof that specifically binds and recognizes an antigen. The recognized immunoglobulin genes include the kappa, lambda, alpha, gamma, delta, epsilon, and mu constant region genes, as well as the myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively. Typically, the antigen-binding region of an antibody will be most critical in specificity and affinity of binding.

An exemplary immunoglobulin (antibody) structural unit comprises a tetramer. Each tetramer is composed of two identical pairs of polypeptide chains, each pair having one "light" (about 25 kD) and one "heavy" chain (about 50-70 kD). The N-terminus of each chain defines a variable region of about 100 to 110 or more amino acids primarily responsible for antigen recognition. The terms variable light chain ($V_L$) and variable heavy chain ($V_H$) refer to these light and heavy chains respectively.

Antibodies exist, e.g., as intact immunoglobulins or as a number of well-characterized fragments produced by digestion with various peptidases. Thus, for example, pepsin digests an antibody below the disulfide linkages in the hinge region to produce F(ab)'$_2$, a dimer of Fab which itself is a light chain joined to $V_H$-$C_H$1 by a disulfide bond. The F(ab)'$_2$ may be reduced under mild conditions to break the disulfide linkage in the hinge region, thereby converting the F(ab)'$_2$ dimer into an Fab' monomer. The Fab' monomer is essentially Fab with part of the hinge region (see *Fundamental Immunology* (Paul ed., 3d ed. 1993). While various antibody fragments are defined in terms of the digestion of an intact antibody, one of skill will appreciate that such fragments may be synthesized de novo either chemically or by using recombinant DNA methodology. Thus, the term antibody, as used herein, also includes antibody fragments either produced by the modification of whole antibodies, or those synthesized de novo using recombinant DNA methodologies (e.g., single chain Fv) or those identified using phage display libraries (see, e.g., McCafferty et al., *Nature* 348:552-554 (1990))

For preparation of antibodies, e.g., recombinant, monoclonal, or polyclonal antibodies, many technique known in the art can be used (see, e.g., Kohler & Milstein, *Nature* 256:495-497 (1975); Kozbor et al., *Immunology Today* 4: 72 (1983); Cole et al., pp. 77-96 in *Monoclonal Antibodies and Cancer Therapy*, Alan R. Liss, Inc. (1985); Coligan, *Current Protocols in Immunology* (1991); Harlow & Lane, *Antibodies, A Laboratory Manual* (1988); and Goding, *Monoclonal Antibodies: Principles and Practice* (2d ed. 1986)). The genes encoding the heavy and light chains of an antibody of interest can be cloned from a cell, e.g., the genes encoding a monoclonal antibody can be cloned from a hybridoma and used to produce a recombinant monoclonal antibody. Gene libraries encoding heavy and light chains of monoclonal antibodies can also be made from hybridoma or plasma cells. Random combinations of the heavy and light chain gene products generate a large pool of antibodies with different antigenic specificity (see, e.g., Kuby, *Immunology* ($3^{rd}$ ed. 1997)). Techniques for the production of single chain antibodies or recombinant antibodies (U.S. Pat. Nos. 4,946,778, 4,816,567) can be adapted to produce antibodies to polypeptides of this invention. Also, transgenic mice, or other organisms such as other mammals, may be used to express humanized or human antibodies (see, e.g., U.S. Pat. Nos. 5,545,807; 5,545,806; 5,569,825; 5,625,126; 5,633,425; 5,661,016, Marks et al., *Bio/Technology* 10:779-783 (1992); Lonberg et al., *Nature* 368:856-859 (1994); Morrison, *Nature* 368:812-13 (1994); Fishwild et al., *Nature Biotechnology* 14:845-51 (1996); Neuberger, *Nature Biotechnology* 14:826 (1996); and Lonberg & Huszar, *Intern. Rev. Immunol.* 13:65-93 (1995)). Alternatively, phage display technology can be used to identify antibodies and heteromeric Fab fragments that specifically bind to selected antigens (see, e.g., McCafferty et al., *Nature* 348:552-554 (1990); Marks et al., *Biotechnology* 10:779-783 (1992)). Antibodies can also be made bispecific, i.e., able to recognize two different antigens (see, e.g., WO 93/08829, Traunecker et al., *EMBO J.* 10:3655-3659 (1991); and Suresh et al., *Methods in Enzymology* 121:210 (1986)). Antibodies can also be heteroconjugates, e.g., two covalently joined antibodies, or immunotoxins (see, e.g., U.S. Pat. No. 4,676,980, WO 91/00360; WO 92/200373; and EP 03089).

Methods for humanizing or primatizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and coworkers (see, e.g., Jones et al., *Nature* 321:522-525 (1986); Riechmann et al., *Nature* 332: 323-327 (1988); Verhoeyen et al., *Science* 239:1534-1536 (1988) and Presta, *Curr. Op. Struct. Biol.* 2:593-596 (1992)), by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

A "chimeric antibody" is an antibody molecule in which (a) the constant region, or a portion thereof, is altered, replaced or exchanged so that the antigen binding site (variable region) is linked to a constant region of a different or altered class, effector function and/or species, or an entirely different molecule which confers new properties to the chimeric antibody, e.g., an enzyme, toxin, hormone, growth factor, drug, etc.; or (b) the variable region, or a portion thereof, is altered, replaced or exchanged with a variable region having a different or altered antigen specificity.

In one embodiment, the antibody is conjugated to an "effector" moiety. The effector moiety can be any number of molecules, including labeling moieties such as radioactive labels or fluorescent labels, or can be a therapeutic moiety. In one aspect the antibody modulates the activity of the protein.

The phrase "specifically (or selectively) binds" to an antibody or "specifically (or selectively) immunoreactive with," when referring to a protein or peptide, refers to a binding reaction that is determinative of the presence of the protein, often in a heterogeneous population of proteins and other biologics. Thus, under designated immunoassay conditions, the specified antibodies bind to a particular protein at least two times the background and more typically more than 10 to 100 times background. Specific binding to an antibody under such conditions requires an antibody that is selected for its specificity for a particular protein. For example, polyclonal antibodies raised to angiogenesis regulatory proteins, polymorphic variants, alleles, orthologs, and conservatively modified variants, or splice variants, or portions thereof, can be selected to obtain only those polyclonal antibodies that are specifically immunoreactive with angiogenesis regulatory proteins and not with other proteins. This selection may be achieved by subtracting out antibodies that cross-react with other molecules. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, *Antibodies, A Laboratory Manual* (1988) for a description of immunoassay formats and conditions that can be used to determine specific immunoreactivity).

Assays for Proteins that Modulate Angiogenesis

High throughput functional genomics assays can be used to identify modulators of angiogenesis. Such assays can monitor changes in cell surface marker expression, $\alpha v \beta 3$ integrin production, proliferation, and differentiation using either cell lines or primary cells, e.g., endothelial cells such as HUVEC cells. Typically, early passage or primary endothelial cells are contacted with a cDNA or a random peptide library (encoded by nucleic acids). Often the libraries are retroviral libraries. The cDNA library can comprise sense, antisense, full length, and truncated cDNAs. The cDNAs are often from endothelial cells, e.g., HUVEC cells, either differentiated on matrigel or 3-d collagen, or undifferentiated. The peptide library is encoded by nucleic acids. The cDNAs are optionally fused to markers such as GFP. The effect of the cDNA or peptide library on the endothelial cells is then monitored, using an assay such as cell surface marker expression (e.g., $\alpha v \beta 3$ integrin or VEGF2-R2) or a phenotypic assay for angiogenesis such as migration towards an ECM (extracellular matrix) component (see, e.g., Klemke et al., *J. Cell Biol.* 4:961-972 (1998)) or endothelial cell tube formation assays, as well as other bioassays such as the chick CAM assay, the mouse corneal assay, haptotaxis assays, and assays measuring the effect of administering potential modulators on implanted tumors. The effect of the cDNA or peptide can be validated and distinguished from somatic mutations, using, e.g., regulatable expression of the nucleic acid such as expression from a tetracycline promoter. cDNAs and nucleic acids encoding peptides can be rescued using techniques known to those of skill in the art, e.g., using a sequence tags.

Proteins interacting with the peptide or with the protein encoded by the cDNA (e.g., angiogenesis regulatory protein) can be isolated using a yeast two-hybrid system, mammalian two hybrid system, immunoprecipitation and proteomics, phage display screen, etc. Targets so identified can be further used as bait in these assays to identify additional members of the angiogenesis pathway, which members are also targets for drug development (see, e.g., Fields et al., *Nature* 340:245 (1989); Vasavada et al., *Proc. Nat'l Acad. Sci. USA* 88:10686 (1991); Fearon et al., *Proc. Nat'l Acad. Sci. USA* 89:7958 (1992); Dang et al., *Mol. Cell. Biol.* 11:954 (1991); Chien et al., *Proc. Nat'l Acad. Sci. USA* 9578 (1991); and U.S. Pat. Nos. 5,283,173, 5,667,973, 5,468,614, 5,525,490, and 5,637,463).

Suitable endothelial cell lines include human umbilical vein cells (see, e.g., Jaffe et al., *J. Clin. Invest.* 52:2745-2754 (1973)); human adult dermal capillary-derived cells (see, e.g., Davison et al., *In Vitro* 19:937-945 (1983)); human adipose capillary derived cells (see, e.g., Kern et al., *J. Clin Invest.* 71:1822-1829 (1983); bovine aorta (see, e.g., Booyse et al., *Thromb. Diathes. Ahemorrh.* 34:825-839 (1975); and rat brain capillary derived cells (see, e.g., Bowman et al., *In Vitro* 17:353-362 (1981)). For culture of endothelial cell lines, explants, and primary cells, see Freshney et al., *Culture of Animal Cells* (3$^{rd}$ ed. 1994). Suitable angiogenesis cell surface markers include αvβ3 integrin (see, e.g., Elicerir & Cheresh, *Cancer J Sci. Am.* 6 Supp. 3:S245-249 (2000), Maeshima et al., *J. Biol. Chem. (Jun.* 8, 2001)).

Cell surface markers such as αvβ3 can be assayed using fluorescently labeled antibodies and FACS. Cell proliferation can be measured using $^3$H-thymidine or dye inclusion. Angiogenesis phenotype is measured by loss of phenotype observation. cDNA libraries are made from any suitable source, preferably from endothelial cells. Libraries encoding random peptides are made according to techniques well known to those of skill in the art (see, e.g., U.S. Pat. Nos. 6,153,380, 6,114,111, and 6,180,343). Any suitable vector can be used for the cDNA and peptide libraries, including, e.g., retroviral vectors.

In a preferred embodiment, target proteins that modulate angiogenesis are identified using a high throughput cell based assay (using a microtiter plate format) and FACS screening for αvβ3 cell surface expression. cDNA libraries are made which include, e.g., sense, antisense, full length, and truncated cDNAs. The cDNAs are cloned into a retroviral vector. Endothelial cells are infected with the library, cultured for a short effector phase and then the cells with reduced αvβ3 surface levels are enriched by antibody staining and magnetic cell sorting. The enriched cell population is then sorted into microtiter plates using fluorescent antibodies and FACS. Resultant cell colonies are analyzed by immunofluorescence for reduced αvβ3 surface levels. Selected colonies are infected with wild type MMLV virus to rescue the proviral vector. The infectious supernatant is used to infect endothelial cells, which are subsequently analyzed for αv β3 levels by FACS. The cDNA is isolated and sequenced to determined if it represents a wild type or mutated cDNA, e.g., whether the cDNA represents a negative transdominant mutant. Optionally, a marker such as GFP can be used to select for retrovirally infected cells. Using this system, cDNA molecules encoding angiogenesis regulatory protein were identified as a targets for antiangiogenic drug therapy. Some of the cDNAs were fused in frame to a GFP marker. Some cDNA molecules were expressed as inhibitory antisense molecules. Finally, some cDNAs were expressed in the antisense orientation and expression of the translated protein or peptide resulted in an angiogenesis phenotype.

Isolation of Nucleic Acids Encoding Angiogenesis Regulatory Proteins

This invention relies on routine techniques in the field of recombinant genetics. Basic texts disclosing the general methods of use in this invention include Sambrook et al., *Molecular Cloning, A Laboratory Manual* (2nd ed. 1989); Kriegler, *Gene Transfer and Expression: A Laboratory Manual* (1990); and *Current Protocols in Molecular Biology* (Ausubel et al., eds., 1994)).

Nucleic acids encoding angiogenesis regulatory proteins and their polymorphic variants, orthologs, and alleles that are substantially identical to the amino acid sequence of SEQ ID NO:4, SEQ ID NO:33, SEQ ID NO:44, SEQ ID NO:58, SEQ ID NO:64, SEQ ID NO:69, SEQ ID NO:71, SEQ ID NO:77, SEQ ID NO:82, SEQ ID NO:87, SEQ ID NO:90, SEQ ID NO:121, SEQ ID NO:129, SEQ ID NO:140, SEQ ID NO:154, SEQ ID NO:164, SEQ ID NO:170, SEQ ID NO:172, SEQ ID NO:174, SEQ ID NO:176, SEQ ID NO:184, SEQ ID NO:203, SEQ ID NO:287, SEQ ID NO:298, SEQ ID NO:309, SEQ ID NO:319, SEQ ID NO:325, SEQ ID NO:331, SEQ ID NO:341, SEQ ID NO:352, SEQ ID NO:366, SEQ ID NO:378, SEQ ID NO:385, SEQ ID NO:407, SEQ ID NO:409, SEQ ID NO:420, SEQ ID NO:429, SEQ ID NO:438, SEQ ID NO:440, SEQ ID NO:446, SEQ ID NO:457, SEQ ID NO:463, SEQ ID NO:482, SEQ ID NO:485, SEQ ID NO:494, SEQ ID NO:497, SEQ ID NO:499, and SEQ ID NO:520 can be isolated using nucleic acid probes and oligonucleotides under stringent hybridization conditions, by screening libraries. Alternatively, expression libraries can be used to clone angiogenesis regulatory proteins, polymorphic variants, orthologs, and alleles by detecting expressed homologs immunologically with antisera or purified antibodies made against a human angiogenesis regulatory protein or portions thereof. To make a cDNA library, one should choose a source that is rich in angiogenesis regulatory protein RNA, e.g., endothelial cells. The mRNA is then made into cDNA using reverse transcriptase, ligated into a recombinant vector, and transfected into a recombinant host for propagation, screening and cloning. Methods for making and screening cDNA libraries are well known (see, e.g., Gubler & Hoffman, *Gene* 25:263-269 (1983); Sambrook et al., supra; Ausubel et al., supra).

For a genomic library, the DNA is extracted from the tissue and either mechanically sheared or enzymatically digested to yield fragments of about 12-20 kb. The fragments are then separated by gradient centrifugation from undesired sizes and are constructed in bacteriophage lambda vectors. These vectors and phage are packaged in vitro. Recombinant phage are analyzed by plaque hybridization as described in Benton & Davis, *Science* 196:180-182 (1977). Colony hybridization is carried out as generally described in Grunstein et al., *Proc. Natl. Acad. Sci. USA.*, 72:3961-3965 (1975).

An alternative method of isolating angiogenesis regulatory protein nucleic acid and its orthologs, alleles, mutants, polymorphic variants, and conservatively modified variants combines the use of synthetic oligonucleotide primers and amplification of an RNA or DNA template (see U.S. Pat. Nos. 4,683,195 and 4,683,202; *PCR Protocols: A Guide to Methods and Applications* (Innis et al., eds, 1990)). Methods such as polymerase chain reaction (PCR) and ligase chain reaction (LCR) can be used to amplify nucleic acid sequences encoding human angiogenesis regulatory proteins directly from mRNA, from cDNA, from genomic libraries or cDNA libraries. Degenerate oligonucleotides can be designed to amplify angiogenesis regulatory protein homologs using the sequences provided herein. Restriction endonuclease sites can be incorporated into the primers. Polymerase chain reaction or other in vitro amplification methods may also be useful, for example, to clone nucleic acid sequences that code for proteins to be expressed, to make nucleic acids to use as probes for detecting the presence of angiogenesis regulatory protein encoding mRNA in physiological samples, for nucleic acid sequencing, or for other purposes. Genes amplified by the PCR reaction can be purified from agarose gels and cloned into an appropriate vector.

Gene expression of angiogenesis regulatory proteins can also be analyzed by techniques known in the art, e.g., reverse transcription and amplification of mRNA, isolation of total RNA or poly $A^+$ RNA, northern blotting, dot blotting, in situ hybridization, RNase protection, high density polynucleotide array technology, e.g., and the like.

Nucleic acids encoding angiogenesis regulatory proteins can be used with high density oligonucleotide array technology (e.g., GeneChip™) to identify angiogenesis regulatory proteins, orthologs, alleles, conservatively modified variants, and polymorphic variants in this invention. In the case where the homologs being identified are linked to a condition such as neovascularization or angiogenic insufficiency, they can be used with GeneChip™ as a diagnostic tool in detecting the disease in a biological sample, see, e.g., Gunthand et al., *AIDS Res. Hum. Retroviruses* 14: 869-876 (1998); Kozal et al., *Nat. Med.* 2:753-759 (1996); Matson et al., *Anal. Biochem.* 224: 110-106 (1995); Lockhart et al., *Nat. Biotechnol.* 14:1675-1680 (1996); Gingeras et al., *Genome Res.* 8:435-448 (1998); Hacia et al., *Nucleic Acids Res.* 26:3865-3866 (1998).

The gene for an angiogenesis regulatory protein is typically cloned into intermediate vectors before transformation into prokaryotic or eukaryotic cells for replication and/or expression. These intermediate vectors are typically prokaryote vectors, e.g., plasmids, or shuttle vectors.

Expression in Prokaryotes and Eukaryotes

To obtain high level expression of a cloned gene, such as those cDNAs encoding an angiogenesis regulatory protein, one typically subclones a gene encoding an angiogenesis regulatory protein into an expression vector that contains a strong promoter to direct transcription, a transcription/translation terminator, and if for a nucleic acid encoding a protein, a ribosome binding site for translational initiation. Suitable bacterial promoters are well known in the art and described, e.g., in Sambrook et al., and Ausubel et al, supra. Bacterial expression systems for expressing angiogenesis regulatory proteins are available in, e.g., *E. coli, Bacillus* sp., and *Salmonella* (Palva et al., *Gene* 22:229-235 (1983); Mosbach et al., *Nature* 302:543-545 (1983). Kits for such expression systems are commercially available. Eukaryotic expression systems for mammalian cells, yeast, and insect cells are well known in the art and are also commercially available.

Selection of the promoter used to direct expression of a heterologous nucleic acid depends on the particular application. The promoter is preferably positioned about the same distance from the heterologous transcription start site as it is from the transcription start site in its natural setting. As is known in the art, however, some variation in this distance can be accommodated without loss of promoter function.

In addition to the promoter, the expression vector typically contains a transcription unit or expression cassette that contains all the additional elements required for the expression of the angiogenesis regulatory protein encoding nucleic acid in host cells. A typical expression cassette thus contains a promoter operably linked to the nucleic acid sequence encoding an angiogenesis regulatory protein and signals required for efficient polyadenylation of the transcript, ribosome binding sites, and translation termination. Additional elements of the cassette may include enhancers and, if genomic DNA is used as the structural gene, introns with functional splice donor and acceptor sites.

In addition to a promoter sequence, the expression cassette should also contain a transcription termination region downstream of the structural gene to provide for efficient termination. The termination region may be obtained from the same gene as the promoter sequence or may be obtained from different genes.

The particular expression vector used to transport the genetic information into the cell is not particularly critical. Any of the conventional vectors used for expression in eukaryotic or prokaryotic cells may be used. Standard bacterial expression vectors include plasmids such as pBR322 based plasmids, pSKF, pET23D, and fusion expression systems such as MBP, GST, and LacZ. Epitope tags can also be added to recombinant proteins to provide convenient methods of isolation, e.g., c-myc.

Expression vectors containing regulatory elements from eukaryotic viruses are typically used in eukaryotic expression vectors, e.g., SV40 vectors, papilloma virus vectors, retroviral vectors, and vectors derived from Epstein-Barr virus. Other exemplary eukaryotic vectors include pMSG, pAV009/$A^+$, pMTO10/$A^+$, pMAMneo-5, baculovirus pDSVE, and any other vector allowing expression of proteins under the direction of the CMV promoter, SV40 early promoter, SV40 later promoter, metallothionein promoter, murine mammary tumor virus promoter, Rous sarcoma virus promoter, polyhedrin promoter, or other promoters shown effective for expression in eukaryotic cells.

Expression of proteins from eukaryotic vectors can be also be regulated using inducible promoters. With inducible promoters, expression levels are tied to the concentration of inducing agents, such as tetracycline or ecdysone, by the incorporation of response elements for these agents into the promoter. Generally, high level expression is obtained from inducible promoters only in the presence of the inducing agent; basal expression levels are minimal. Inducible expression vectors are often chosen if expression of the protein of interest is detrimental to eukaryotic cells.

In one embodiment, the vectors of the invention have a regulatable promoter, e.g., tet-regulated systems and the RU-486 system (see, e.g., Gossen & Bujard, *Proc. Nat'l Acad. Sci. USA* 89:5547 (1992); Oligino et al., *Gene Ther.* 5:491-496 (1998); Wang et al., *Gene Ther.* 4:432-441 (1997); Neering et al., *Blood* 88:1147-1155 (1996); and Rendahl et al., *Nat. Biotechnol.* 16:757-761 (1998)). These impart small molecule control on the expression of the candidate target nucleic acids. This beneficial feature can be used to determine that a desired phenotype is caused by a transfected cDNA rather than a somatic mutation.

Some expression systems have markers that provide gene amplification such as thymidine kinase and dihydrofolate reductase. Alternatively, high yield expression systems not involving gene amplification are also suitable, such as using a baculovirus vector in insect cells, with a angiogenesis regulatory protein encoding sequence under the direction of the polyhedrin promoter or other strong baculovirus promoters.

The elements that are typically included in expression vectors also include a replicon that functions in *E. coli*, a gene encoding antibiotic resistance to permit selection of bacteria that harbor recombinant plasmids, and unique restriction sites in nonessential regions of the plasmid to allow insertion of eukaryotic sequences. The particular antibiotic resistance gene chosen is not critical, any of the many resistance genes known in the art are suitable. The prokaryotic sequences are preferably chosen such that they do not interfere with the replication of the DNA in eukaryotic cells, if necessary.

Standard transfection methods are used to produce bacterial, mammalian, yeast or insect cell lines that express large quantities of angiogenesis regulatory proteins, which are then purified using standard techniques (see, e.g., Colley et al., *J. Biol. Chem.* 264:17619-17622 (1989); *Guide to Protein Purification*, in *Methods in Enzymology*, vol. 182 (Deutscher, ed., 1990)). Transformation of eukaryotic and prokaryotic cells are performed according to standard techniques (see, e.g., Morrison, *J. Bact.* 132:349-351 (1977); Clark-Curtiss & Curtiss, *Methods in Enzymology* 101:347-362 (Wu et al., eds, 1983).

Any of the well-known procedures for introducing foreign nucleotide sequences into host cells may be used. These include the use of calcium phosphate transfection, polybrene, protoplast fusion, electroporation, biolistics, liposomes, microinjection, plasma vectors, viral vectors and any of the other well known methods for introducing cloned genomic DNA, cDNA, synthetic DNA or other foreign genetic material into a host cell (see, e.g., Sambrook et al., supra). It is only necessary that the particular genetic engineering procedure used be capable of successfully introducing at least one gene into the host cell capable of expressing angiogenesis regulatory protein.

After the expression vector is introduced into the cells, the transfected cells are cultured under conditions favoring expression of angiogenesis regulatory protein, which is recovered from the culture using standard techniques identified below.

Purification of Angiogenesis Regulatory Proteins

Either naturally occurring or recombinant angiogenesis regulatory proteins can be purified for use in functional assays. Naturally occurring angiogenesis regulatory protein can be purified, e.g., from human tissue. Recombinant angiogenesis regulatory protein can be purified from any suitable expression system.

The angiogenesis regulatory proteins may be purified to substantial purity by standard techniques, including selective precipitation with such substances as ammonium sulfate; column chromatography, immunopurification methods, and others (see, e.g., Scopes, *Protein Purification: Principles and Practice* (1982); U.S. Pat. No. 4,673,641; Ausubel et al., supra; and Sambrook et al., supra).

A number of procedures can be employed when recombinant angiogenesis regulatory proteins are being purified. For example, proteins having established molecular adhesion properties can be reversible fused to the angiogenesis regulatory proteins. With the appropriate ligand, the angiogenesis regulatory proteins can be selectively adsorbed to a purification column and then freed from the column in a relatively pure form. The fused protein is then removed by enzymatic activity. Finally, the angiogenesis regulatory proteins could be purified using immunoaffinity columns.

A. Purification of Angiogenesis Regulatory Proteins from Recombinant Bacteria

Recombinant proteins are expressed by transformed bacteria in large amounts, typically after promoter induction; but expression can be constitutive. Promoter induction with IPTG is one example of an inducible promoter system. Bacteria are grown according to standard procedures in the art. Fresh or frozen bacteria cells are used for isolation of protein.

Proteins expressed in bacteria may form insoluble aggregates ("inclusion bodies"). Several protocols are suitable for purification of inclusion bodies containing angiogenesis regulatory proteins. For example, purification of inclusion bodies typically involves the extraction, separation and/or purification of inclusion bodies by disruption of bacterial cells, e.g., by incubation in a buffer of 50 mM TRIS/HCL pH 7.5, 50 mM NaCl, 5 mM $MgCl_2$, 1 mM DTT, 0.1 mM ATP, and 1 mM PMSF. The cell suspension can be lysed using 2-3 passages through a French Press, homogenized using a Polytron (Brinkman Instruments) or sonicated on ice. Alternate methods of lysing bacteria are apparent to those of skill in the art (see, e.g., Sambrook et al., supra; Ausubel et al., supra).

If necessary, the inclusion bodies are solubilized, and the lysed cell suspension is typically centrifuged to remove unwanted insoluble matter. Proteins that formed the inclusion bodies may be renatured by dilution or dialysis with a compatible buffer. Suitable solvents include, but are not limited to urea (from about 4 M to about 8 M), formamide (at least about 80%, volume/volume basis), and guanidine hydrochloride (from about 4 M to about 8 M). Some solvents which are capable of solubilizing aggregate-forming proteins, for example SDS (sodium dodecyl sulfate), 70% formic acid, are inappropriate for use in this procedure due to the possibility of irreversible denaturation of the proteins, accompanied by a lack of immunogenicity and/or activity. Although guanidine hydrochloride and similar agents are denaturants, this denaturation is not irreversible and renaturation may occur upon removal (by dialysis, for example) or dilution of the denaturant, allowing re-formation of immunologically and/or biologically active protein. Other suitable buffers are known to those skilled in the art. Human angiogenesis regulatory proteins are separated from other bacterial proteins by standard separation techniques, e.g., with Ni-NTA agarose resin.

Alternatively, it is possible to purify angiogenesis regulatory proteins from bacteria periplasm. After lysis of the bacteria, when the angiogenesis regulatory proteins are exported into the periplasm of the bacteria, the periplasmic fraction of the bacteria can be isolated by cold osmotic shock in addition to other methods known to skill in the art. To isolate recombinant proteins from the periplasm, the bacterial cells are centrifuged to form a pellet. The pellet is resuspended in a buffer containing 20% sucrose. To lyse the cells, the bacteria are centrifuged and the pellet is resuspended in ice-cold 5 mM $MgSO_4$ and kept in an ice bath for approximately 10 minutes. The cell suspension is centrifuged and the supernatant decanted and saved. The recombinant proteins present in the supernatant can be separated from the host proteins by standard separation techniques well known to those of skill in the art.

B. Standard Protein Separation Techniques for Purifying Angiogenesis Regulatory Proteins Solubility fractionation Often as an initial step, particularly if the protein mixture is complex, an initial salt fractionation can separate many of the unwanted host cell proteins (or proteins derived from the cell culture media) from the recombinant protein of interest. The preferred salt is ammonium sulfate. Ammonium sulfate precipitates proteins by effectively reducing the amount of water in the protein mixture. Proteins then precipitate on the basis of their solubility. The more hydrophobic a protein is, the more likely it is to precipitate at lower ammonium sulfate concentrations. A typical protocol includes adding saturated ammonium sulfate to a protein solution so that the resultant ammonium sulfate concentration is between 20-30%. This concentration will precipitate the most hydrophobic of proteins. The precipitate is then discarded (unless the protein of interest is hydrophobic) and ammonium sulfate is added to the supernatant to a concentration known to precipitate the protein of interest. The precipitate is then solubilized in buffer and the excess salt removed if necessary, either through dialysis or diafiltration. Other methods that rely on solubility of proteins, such as cold ethanol precipitation, are well known to those of skill in the art and can be used to fractionate complex protein mixtures.

Size Differential Filtration

The molecular weight of the angiogenesis regulatory proteins can be used to isolate it from proteins of greater and lesser size using ultrafiltration through membranes of different pore size (for example, Amicon or Millipore membranes). As a first step, the protein mixture is ultrafiltered through a membrane with a pore size that has a lower molecular weight cut-off than the molecular weight of the protein of interest. The retentate of the ultrafiltration is then ultrafiltered against a membrane with a molecular cut off greater than the molecular weight of the protein of interest. The recombinant protein will pass through the membrane into the filtrate. The filtrate can then be chromatographed as described below.

Column Chromatography

The angiogenesis regulatory proteins can also be separated from other proteins on the basis of its size, net surface charge, hydrophobicity, and affinity for ligands. In addition, antibodies raised against proteins can be conjugated to column matrices and the proteins immunopurified. All of these methods are well known in the art. It will be apparent to one of skill that chromatographic techniques can be performed at any scale and using equipment from many different manufacturers (e.g., Pharmacia Biotech).

Assays for Modulators of Angiogenesis Regulatory Proteins and Angiogenesis

A. Assays

Modulation of a angiogenesis regulatory proteins, and corresponding modulation of angiogenesis, can be assessed using a variety of in vitro and in vivo assays, including high throughput ligand binding and cell based assays, as described herein. Such assays can be used to test for inhibitors and activators of angiogenesis regulatory proteins, and, consequently, inhibitors and activators of angiogenesis. Such modulators of angiogenesis regulatory proteins are useful for treating angiogenesis disorders. Modulators of angiogenesis regulatory proteins are tested using either recombinant or naturally occurring angiogenesis regulatory protein, preferably human angiogenesis regulatory protein.

Preferably, the angiogenesis regulatory proteins will have the sequence displayed in SEQ ID NO:4, SEQ ID NO:33, SEQ ID NO:44, SEQ ID NO:58, SEQ ID NO:64, SEQ ID NO:69, SEQ ID NO:71, SEQ ID NO:77, SEQ ID NO:82, SEQ ID NO:87, SEQ ID NO:90, SEQ ID NO:121, SEQ ID NO:129, SEQ ID NO:140, SEQ ID NO:154, SEQ ID NO:164, SEQ ID NO:170, SEQ ID NO:172, SEQ ID NO:174, SEQ ID NO:176, SEQ ID NO:184, SEQ ID NO:203, SEQ ID NO:287, SEQ ID NO:298, SEQ ID NO:309, SEQ ID NO:319, SEQ ID NO:325, SEQ ID NO:331, SEQ ID NO:341, SEQ ID NO:352, SEQ ID NO:366, SEQ ID NO:378, SEQ ID NO:385, SEQ ID NO:407, SEQ ID NO:409, SEQ ID NO:420, SEQ ID NO:429, SEQ ID NO:438, SEQ ID NO:440, SEQ ID NO:446, SEQ ID NO:457, SEQ ID NO:463, SEQ ID NO:482, SEQ ID NO:485, SEQ ID NO:494, SEQ ID NO:497, SEQ ID NO:499, and SEQ ID NO:520 or a conservatively modified variant thereof. Alternatively, the angiogenesis regulatory proteins of the assay will be derived from a eukaryote and include an amino acid subsequence having substantial amino acid sequence identity to SEQ ID NO:4, SEQ ID NO:33, SEQ ID NO:44, SEQ ID NO:58, SEQ ID NO:64, SEQ ID NO:69, SEQ ID NO:71, SEQ ID NO:77, SEQ ID NO:82, SEQ ID NO:87, SEQ ID NO:90, SEQ ID NO:121, SEQ ID NO:129, SEQ ID NO:140, SEQ ID NO:154, SEQ ID NO:164, SEQ ID NO:170, SEQ ID NO:172, SEQ ID NO:174, SEQ ID NO:176, SEQ ID NO:184, SEQ ID NO:203, SEQ ID NO:287, SEQ ID NO:298, SEQ ID NO:309, SEQ ID NO:319, SEQ ID NO:325, SEQ ID NO:331, SEQ ID NO:341, SEQ ID NO:352, SEQ ID NO:366, SEQ ID NO:378, SEQ ID NO:385, SEQ ID NO:407, SEQ ID NO:409, SEQ ID NO:420, SEQ ID NO:429, SEQ ID NO:438, SEQ ID NO:440, SEQ ID NO:446, SEQ ID NO:457, SEQ ID NO:463, SEQ ID NO:482, SEQ ID NO:485, SEQ ID NO:494, SEQ ID NO:497, SEQ ID NO:499, and SEQ ID NO:520. Generally, the amino acid sequence identity will be at least 60%, preferably at least 65%, 70%, 75%, 80%, 85%, or 90%, most preferably at least 95%.

Measurement of an angiogenic or loss-of-angiogenesis phenotype in angiogenesis regulatory proteins or cells expressing angiogenesis regulatory proteins, either recombinant or naturally occurring, can be performed using a variety of assays, in vitro, in vivo, and ex vivo. For example, recombinant or naturally occurring angiogenesis regulatory protein can be used in vitro, in a ligand binding or enzymatic function assay. Angiogenesis regulatory proteins present in a cellular extract can also be used in in vitro assays. Cell- and animal-based in vivo assays can also be used to assay for angiogenesis regulatory protein modulators. Any suitable physical, chemical, or phenotypic change that affects activity or binding can be used to assess the influence of a test compound on the polypeptide of this invention. When the functional effects are determined using intact cells or animals, one can also measure a variety of effects such as, in the case of angiogenesis associated with tumors, tumor growth, neovascularization, cell surface markers such as $\alpha v \beta 3$, hormone release, transcriptional changes to both known and uncharacterized genetic markers (e.g., northern blots), changes in cell metabolism such as cell growth or pH changes, and changes in intracellular second messengers such as cGMP. In one embodiment, measurement of $\alpha v \beta 3$ integrin cell surface expression and FACS sorting is used to identify modulators of angiogenesis.

In Vitro Assays

Assays to identify compounds with angiogenesis regulatory protein modulating activity, e.g., anti-angiogenic activity, can be performed in vitro, e.g., binding assays. Such assays can used full length angiogenesis regulatory proteins or a variant thereof (see, e.g., SEQ ID NO:2), or a fragment of an angiogenesis regulatory proteins having a desired activity. Purified recombinant or naturally occurring angiogenesis regulatory proteins can be used in the in vitro methods of the invention. In addition to purified angiogenesis regulatory proteins, the recombinant or naturally occurring angiogenesis regulatory proteins can be part of a cellular lysate. As described below, the assay can be either solid state or soluble. Preferably, the protein is bound to a solid support, either covalently or noncovalently. Often, the in vitro assays of the invention are ligand binding or ligand affinity assays, either non-competitive or competitive. Other in vitro assays include measuring changes in spectroscopic (e.g., fluorescence, absorbance, refractive index), hydrodynamic (e.g., shape), chromatographic, or solubility properties for the protein.

In one embodiment, a high throuput binding assay is performed in which the angiogenesis regulatory proteins or chimera comprising a fragment thereof is contacted with a potential modulator and incubated for a suitable amount of time. In one embodiment, the potential modulator is bound to a solid support, and the angiogenesis regulatory proteins is added. In another embodiment, the angiogenesis regulatory proteins is bound to a solid support. A wide variety of modulators can be used, as described below, including small organic molecules, peptides, and antibodies. A wide variety of assays can be used to identify angiogenesis regulatory protein-modulator binding or enzymatic activity, including labeled protein-protein binding assays, electrophoretic mobility shifts, immunoassays, and the like. In some cases, the binding of the candidate modulator is determined through the use of competitive binding assays, where interference with binding of a known ligand is measured in the presence of a potential modulator. Often, either the potential modulator or the known ligand is labeled. Binding of the candidate modulator can also be assessed by determining its effect on the enzymatic activity of an angiogenesis regulatory protein.

Cell-Based In Vivo Assays

In another embodiment, an angiogenesis regulatory proteins is expressed in a cell, and functional, e.g., physical and chemical or phenotypic, changes are assayed to identify angiogenesis modulators, preferably anti-angiogenesis compounds. Cells expressing angiogenesis regulatory proteins can also be used in binding assays or enzymatic assays. Any suitable functional effect can be measured, as described herein. For example, ligand binding, cell surface marker expression, cellular proliferation, cellular differentiation assays and cell migration assays are all suitable assays to identify potential modulators using a cell based system. Suitable cells for such cell based assays include both primary endothelial cells and cell lines, as described herein. The angiogenesis regulatory proteins can be naturally occurring or recombinant. Also, as described above, a fragment of an angiogenesis regulatory protein with a desired activity can be used in cell based assays.

As described above, in one embodiment, loss-of angiogenesis phenotype is measured by contacting endothelial cells comprising an angiogenesis regulatory protein target with a potential modulator. Modulation of angiogenesis is identified by screening for cell surface marker expression, e.g., αvβ3 integrin expression levels, using fluorescent antibodies and FACS sorting.

In another embodiment, cellular angiogenesis regulatory protein levels are determined by measuring the level of protein or mRNA. The level of angiogenesis regulatory protein or proteins are measured using immunoassays such as western blotting, ELISA and the like with an antibody that selectively binds to the angiogenesis regulatory protein polypeptide or a fragment thereof. For measurement of mRNA, amplification, e.g., using PCR, LCR, or hybridization assays, e.g., northern hybridization, RNAse protection, dot blotting, are preferred. The level of protein or mRNA is detected using directly or indirectly labeled detection agents, e.g., fluorescently or radioactively labeled nucleic acids, radioactively or enzymatically labeled antibodies, and the like, as described herein.

Alternatively, angiogenesis regulatory protein expression can be measured using a reporter gene system. Such a system can be devised using a angiogenesis regulatory proteins promoter operably linked to a reporter gene such as chloramphenicol acetyltransferase, firefly luciferase, bacterial luciferase, β-galactosidase and alkaline phosphatase. Furthermore, the protein of interest can be used as an indirect reporter via attachment to a second reporter such as red or green fluorescent protein (see, e.g., Mistili & Spector, *Nature Biotechnology* 15:961-964 (1997)). The reporter construct is typically transfected into a cell. After treatment with a potential modulator, the amount of reporter gene transcription, translation, or activity is measured according to standard techniques known to those of skill in the art.

In another embodiment, angiogenesis regulatory protein enzymatic activity can be measured, using, e.g., labeled substrate proteins, gel electrophoresis, and ELISA assays, and other appropriate enzymatic activities.

A variety of phenotypic angiogenesis assays are known to those of skill in the art. Various models have been employed to evaluate angiogenesis (e.g., Croix et al., *Science* 289:1197-1202 (2000) and Kahn et al., *Amer. J. Pathol.* 156:1887-1900). Assessment of angiogenesis in the presence of a potential modulator of angiogenesis can be performed using cell-culture-based angiogenesis assays, e.g., endothelial cell tube formation assays, cellular differentiation assays using matrigel matrix or by co-culture with smooth muscle cells, chemotaxis assays using VEGF or FGF, and haptotaxis assays, as well as other animal based bioassays such as the chick CAM assay, the mouse corneal assay, and assays measuring the effect of administering potential modulators on implanted tumors.

Animal Models

A number of animal based assays for angiogenesis phenotypes are known to those of skill in the art and can be used to assay for modulators of angiogenesis. For example, the chick CAM assay is described by O'Reilly, et al. *Cell* 79: 315-328 (1994). Briefly, 3 day old chicken embryos with intact yolks are separated from the egg and placed in a petri dish. After 3 days of incubation, a methylcellulose disc containing the protein to be tested is applied to the CAM of individual embryos. After about 48 hours of incubation, the embryos and CAMs are observed to determine whether endothelial growth has been inhibited.

The mouse corneal assay involves implanting a growth factor-containing pellet, along with another pellet containing the suspected endothelial growth inhibitor, in the cornea of a mouse and observing the pattern of capillaries that are elaborated in the cornea.

Angiogenesis can also be measured by determining the extent of neovascularization of a tumor. For example, carcinoma cells can be subcutaneously inoculated into athymic nude mice and tumor growth then monitored. Immunoassays using endothelial cell-specific antibodies are typically used to stain for vascularization of tumor and the number of vessels in the tumor.

As described above, animal models of angiogenesis find use in screening for modulators of angiogenesis. Similarly, transgenic animal technology including gene knockout technology, for example as a result of homologous recombination with an appropriate gene targeting vector, or gene overexpression, will result in the absence or increased expression of the angiogenesis regulatory proteins. The same technology can also be applied to make knock-out cells. When desired, tissue-specific expression or knockout of the gene encoding an angiogenesis regulatory protein may be necessary. Transgenic animals generated by such methods find use as animal models of angiogenesis and are additionally useful in screening for modulators of angiogenesis.

Knock-out cells and transgenic mice can be made by insertion of a marker gene or other heterologous gene into the endogenous gene site encoding an angiogenesis regulatory protein in the mouse genome via homologous recombination. Such mice can also be made by substituting the endogenous angiogenesis regulatory protein with a mutated version of angiogenesis regulatory protein, or by mutating the endogenous angiogenesis regulatory protein, e.g., by exposure to carcinogens.

A DNA construct is introduced into the nuclei of embryonic stem cells. Cells containing the newly engineered genetic lesion are injected into a host mouse embryo, which is re-implanted into a recipient female. Some of these embryos develop into chimeric mice that possess germ cells partially derived from the mutant cell line. Therefore, by breeding the chimeric mice it is possible to obtain a new line of mice containing the introduced genetic lesion (see, e.g., Capecchi et al., *Science* 244:1288 (1989)). Chimeric targeted mice can be derived according to Hogan et al., *Manipulating the Mouse Embryo: A Laboratory Manual*, Cold Spring Harbor Laboratory (1988) and *Teratocarcinomas and Embryonic Stem Cells: A Practical Approach*, Robertson, ed., IRL Press, Washington, D.C., (1987).

B. Modulators

The compounds tested as modulators of angiogenesis regulatory proteins can be any small organic molecule, or a biological entity, such as a protein, e.g., an antibody or peptide, a sugar, a nucleic acid, e.g., an antisense oligonucleotide, RNAi, or a ribozyme, or a lipid. Alternatively, modulators can be genetically altered versions of an angiogenesis regulatory proteins. Typically, test compounds will be small organic molecules, peptides, lipids, and lipid analogs.

Essentially any chemical compound can be used as a potential modulator or ligand in the assays of the invention, although most often compounds can be dissolved in aqueous or organic (especially DMSO-based) solutions are used. The assays are designed to screen large chemical libraries by automating the assay steps and providing compounds from any convenient source to assays, which are typically run in parallel (e.g., in microtiter formats on microtiter plates in robotic assays). It will be appreciated that there are many suppliers of chemical compounds, including Sigma (St. Louis, Mo.), Aldrich (St. Louis, Mo.), Sigma-Aldrich (St. Louis, Mo.), Fluka Chemika-Biochemica Analytika (Buchs Switzerland) and the like.

In one preferred embodiment, high throughput screening methods involve providing a combinatorial small organic molecule or peptide library containing a large number of potential therapeutic compounds (potential modulator or ligand compounds). Such "combinatorial chemical libraries" or "ligand libraries" are then screened in one or more assays, as described herein, to identify those library members (particular chemical species or subclasses) that display a desired characteristic activity. The compounds thus identified can serve as conventional "lead compounds" or can themselves be used as potential or actual therapeutics.

A combinatorial chemical library is a collection of diverse chemical compounds generated by either chemical synthesis or biological synthesis, by combining a number of chemical "building blocks" such as reagents. For example, a linear combinatorial chemical library such as a polypeptide library is formed by combining a set of chemical building blocks (amino acids) in every possible way for a given compound length (i.e., the number of amino acids in a polypeptide compound). Millions of chemical compounds can be synthesized through such combinatorial mixing of chemical building blocks.

Preparation and screening of combinatorial chemical libraries is well known to those of skill in the art. Such combinatorial chemical libraries include, but are not limited to, peptide libraries (see, e.g., U.S. Pat. No. 5,010,175, Furka, *Int. J. Pept. Prot. Res.* 37:487-493 (1991) and Houghton et al., *Nature* 354:84-88 (1991)). Other chemistries for generating chemical diversity libraries can also be used. Such chemistries include, but are not limited to: peptoids (e.g., PCT Publication No. WO 91/19735), encoded peptides (e.g., PCT Publication No. WO 93/20242), random bio-oligomers (e.g., PCT Publication No. WO 92/00091), benzodiazepines (e.g., U.S. Pat. No. 5,288,514), diversomers such as hydantoins, benzodiazepines and dipeptides (Hobbs et al., *Proc. Nat. Acad. Sci. USA* 90:6909-6913 (1993)), vinylogous polypeptides (Hagihara et al., *J. Amer. Chem. Soc.* 114:6568 (1992)), nonpeptidal peptidomimetics with glucose scaffolding (Hirschmann et al., *J. Amer. Chem. Soc.* 114:9217-9218 (1992)), analogous organic syntheses of small compound libraries (Chen et al., *J. Amer. Chem. Soc.* 116:2661 (1994)), oligocarbamates (Cho et al., *Science* 261:1303 (1993)), and/or peptidyl phosphonates (Campbell et al., *J. Org. Chem.* 59:658 (1994)), nucleic acid libraries (see Ausubel, Berger and Sambrook, all supra), peptide nucleic acid libraries (see, e.g., U.S. Pat. No. 5,539,083), antibody libraries (see, e.g., Vaughn et al., *Nature Biotechnology*, 14(3):309-314 (1996) and PCT/US96/10287), carbohydrate libraries (see, e.g., Liang et al., *Science*, 274:1520-1522 (1996) and U.S. Pat. No. 5,593,853), small organic molecule libraries (see, e.g., benzodiazepines, Baum C&EN, January 18, page 33 (1993); isoprenoids, U.S. Pat. No. 5,569,588; thiazolidinones and metathiazanones, U.S. Pat. No. 5,549,974; pyrrolidines, U.S. Pat. Nos. 5,525,735 and 5,519,134; morpholino compounds, U.S. Pat. No. 5,506,337; benzodiazepines, 5,288,514, and the like).

Devices for the preparation of combinatorial libraries are commercially available (see, e.g., 357 MPS, 390 MPS, Advanced Chem Tech, Louisville Ky., Symphony, Rainin, Woburn, Mass., 433A Applied Biosystems, Foster City, Calif., 9050 Plus, Millipore, Bedford, Mass.). In addition, numerous combinatorial libraries are themselves commercially available (see, e.g., ComGenex, Princeton, N.J., Asinex, Moscow, Ru, Tripos, Inc., St. Louis, Mo., ChemStar, Ltd, Moscow, RU, 3D Pharmaceuticals, Exton, Pa., Martek Biosciences, Columbia, Md., etc.).

C. Solid State and Soluble High Throughput Assays

In one embodiment the invention provides soluble assays using angiogenesis regulatory proteins, or a cell or tissue expressing angiogenesis regulatory proteins, either naturally occurring or recombinant. In another embodiment, the invention provides solid phase based in vitro assays in a high throughput format, where the angiogenesis regulatory protein is attached to a solid phase substrate. Any one of the assays described herein can be adapted for high throughput screening, e.g., ligand binding, cellular proliferation, cell surface marker flux, e.g., $\alpha v \beta 3$ integrin, enzymatic activity, etc. In one preferred embodiment, the cell-based system using $\alpha v \beta 3$ integrin modulation and FACS assays is used in a high throughput format for identifying modulators of angiogenesis regulatory proteins, and therefore modulators of T cell angiogenesis.

In the high throughput assays of the invention, either soluble or solid state, it is possible to screen up to several thousand different modulators or ligands in a single day. This methodology can be used for angiogenesis regulatory proteins in vitro, or for cell-based assays comprising an angiogenesis regulatory proteins. In particular, each well of a microtiter plate can be used to run a separate assay against a selected potential modulator, or, if concentration or incubation time effects are to be observed, every 5-10 wells can test a single modulator. Thus, a single standard microtiter plate can assay about 100 (e.g., 96) modulators. If 1536 well plates are used, then a single plate can easily assay from about 100

-about 1500 different compounds. It is possible to assay many plates per day; assay screens for up to about 6,000, 20,000, 50,000, or more than 100,000 different compounds are possible using the integrated systems of the invention.

For a solid state reaction, the protein of interest or a fragment thereof, e.g., an extracellular domain, or a cell comprising the protein of interest or a fragment thereof as part of a fusion protein can be bound to the solid state component, directly or indirectly, via covalent or non covalent linkage e.g., via a tag. The tag can be any of a variety of components. In general, a molecule which binds the tag (a tag binder) is fixed to a solid support, and the tagged molecule of interest is attached to the solid support by interaction of the tag and the tag binder.

A number of tags and tag binders can be used, based upon known molecular interactions well described in the literature. For example, where a tag has a natural binder, for example, biotin, protein A, or protein G, it can be used in conjunction with appropriate tag binders (avidin, streptavidin, neutravidin, the Fc region of an immunoglobulin, etc.) Antibodies to molecules with natural binders such as biotin are also widely available and appropriate tag binders; see, SIGMA Immunochemicals 1998 catalogue SIGMA, St. Louis Mo.).

Similarly, any haptenic or antigenic compound can be used in combination with an appropriate antibody to form a tag/tag binder pair. Thousands of specific antibodies are commercially available and many additional antibodies are described in the literature. For example, in one common configuration, the tag is a first antibody and the tag binder is a second antibody which recognizes the first antibody. In addition to antibody-antigen interactions, receptor-ligand interactions are also appropriate as tag and tag-binder pairs. For example, agonists and antagonists of cell membrane receptors (e.g., cell receptor-ligand interactions such as transferrin, c-kit, viral receptor ligands, cytokine receptors, chemokine receptors, interleukin receptors, immunoglobulin receptors and antibodies, the cadherein family, the integrin family, the selectin family, and the like; see, e.g., Pigott & Power, *The Adhesion Molecule Facts Book I* (1993). Similarly, toxins and venoms, viral epitopes, hormones (e.g., opiates, steroids, etc.), intracellular receptors (e.g. which mediate the effects of various small ligands, including steroids, thyroid hormone, retinoids and vitamin D; peptides), drugs, lectins, sugars, nucleic acids (both linear and cyclic polymer configurations), oligosaccharides, proteins, phospholipids and antibodies can all interact with various cell receptors.

Synthetic polymers, such as polyurethanes, polyesters, polycarbonates, polyureas, polyamides, polyethyleneimines, polyarylene sulfides, polysiloxanes, polyimides, and polyacetates can also form an appropriate tag or tag binder. Many other tag/tag binder pairs are also useful in assay systems described herein, as would be apparent to one of skill upon review of this disclosure.

Common linkers such as peptides, polyethers, and the like can also serve as tags, and include polypeptide sequences, such as poly gly sequences of between about 5 and 200 amino acids. Such flexible linkers are known to persons of skill in the art. For example, poly(ethelyne glycol) linkers are available from Shearwater Polymers, Inc. Huntsville, Ala. These linkers optionally have amide linkages, sulfhydryl linkages, or heterofunctional linkages.

Tag binders are fixed to solid substrates using any of a variety of methods currently available. Solid substrates are commonly derivatized or functionalized by exposing all or a portion of the substrate to a chemical reagent which fixes a chemical group to the surface which is reactive with a portion of the tag binder. For example, groups which are suitable for attachment to a longer chain portion would include amines, hydroxyl, thiol, and carboxyl groups. Aminoalkylsilanes and hydroxyalkylsilanes can be used to functionalize a variety of surfaces, such as glass surfaces. The construction of such solid phase biopolymer arrays is well described in the literature. See, e.g., Merrifield, *J. Am. Chem. Soc.* 85:2149 -2154 (1963) (describing solid phase synthesis of, e.g., peptides); Geysen et al., *J. Immun. Meth.* 102:259-274 (1987) (describing synthesis of solid phase components on pins); Frank & Doring, *Tetrahedron* 44:60316040 (1988) (describing synthesis of various peptide sequences on cellulose disks); Fodor et al., *Science,* 251:767-777 (1991); Sheldon et al., *Clinical Chemistry* 39(4):718-719 (1993); and Kozal et al., *Nature Medicine* 2(7):753759 (1996) (all describing arrays of biopolymers fixed to solid substrates). Non-chemical approaches for fixing tag binders to substrates include other common methods, such as heat, cross-linking by UV radiation, and the like.

Antibodies to Angiogenesis Regulatory Proteins

In addition to the detection of genes encoding angiogenesis regulatory proteins and gene expression using nucleic acid hybridization technology, one can also use immunoassays to detect angiogenesis regulatory proteins of the invention. Such assays are useful for screening for modulators of angiogenesis regulatory proteins and angiogenesis, as well as for therapeutic and diagnostic applications. Immunoassays can be used qualitatively or quantitatively to analyze angiogenesis regulatory proteins. A general overview of the applicable technology can be found in Harlow & Lane, *Antibodies: A Laboratory Manual* (1988).

A. Production of Antibodies Methods of producing polyclonal and monoclonal antibodies that react specifically with the angiogenesis regulatory proteins are known to those of skill in the art (see, e.g., Coligan, *Current Protocols in Immunology* (1991); Harlow & Lane, supra; Goding, *Monoclonal Antibodies: Principles and Practice* (2d ed. 1986); and Kohler & Milstein, *Nature* 256:495-497 (1975). Such techniques include antibody preparation by selection of antibodies from libraries of recombinant antibodies in phage or similar vectors, as well as preparation of polyclonal and monoclonal antibodies by immunizing rabbits or mice (see, e.g., Huse et al., *Science* 246:1275-1281 (1989); Ward et al., *Nature* 341:544-546 (1989)).

A number of immunogens comprising portions of angiogenesis regulatory proteins may be used to produce antibodies specifically reactive with angiogenesis regulatory proteins. For example, recombinant angiogenesis regulatory proteins or an antigenic fragment thereof, can be isolated as described herein. Recombinant protein can be expressed in eukaryotic or prokaryotic cells as described above, and purified as generally described above. Recombinant protein is the preferred immunogen for the production of monoclonal or polyclonal antibodies. Alternatively, a synthetic peptide derived from the sequences disclosed herein and conjugated to a carrier protein can be used an immunogen. Naturally occurring protein may also be used either in pure or impure form. The product is then injected into an animal capable of producing antibodies. Either monoclonal or polyclonal antibodies may be generated, for subsequent use in immunoassays to measure the protein.

Methods of production of polyclonal antibodies are known to those of skill in the art. An inbred strain of mice (e.g., BALB/C mice) or rabbits is immunized with the protein using a standard adjuvant, such as Freund's adjuvant, and a standard immunization protocol. The animal's immune response to the immunogen preparation is monitored by taking test bleeds and determining the titer of reactivity to the beta subunits. When appropriately high titers of antibody to the immunogen are obtained, blood is collected from the animal and antisera are prepared. Further fractionation of the antisera to enrich for antibodies reactive to the protein can be done if desired (see, Harlow & Lane, supra).

Monoclonal antibodies may be obtained by various techniques familiar to those skilled in the art. Briefly, spleen cells from an animal immunized with a desired antigen are immortalized, commonly by fusion with a myeloma cell (see, Kohler & Milstein, *Eur. J. Immunol.* 6:511-519 (1976)). Alternative methods of immortalization include transformation with Epstein Barr Virus, oncogenes, or retroviruses, or other methods well known in the art. Colonies arising from single immortalized cells are screened for production of antibodies of the desired specificity and affinity for the antigen, and yield of the monoclonal antibodies produced by such cells may be enhanced by various techniques, including injection into the peritoneal cavity of a vertebrate host. Alternatively, one may isolate DNA sequences which encode a monoclonal antibody or a binding fragment thereof by screening a DNA library from human B cells according to the general protocol outlined by Huse, et al., *Science* 246:1275-1281 (1989).

Monoclonal antibodies and polyclonal sera are collected and titered against the immunogen protein in an immunoassay, for example, a solid phase immunoassay with the immunogen immobilized on a solid support. Typically, polyclonal antisera with a titer of $10^4$ or greater are selected and tested for their cross reactivity against non-angiogenesis regulatory proteins, using a competitive binding immunoassay. Specific polyclonal antisera and monoclonal antibodies will usually bind with a $K_d$ of at least about 0.1 mM, more usually at least about 1 µM, preferably at least about 0.1 µM or better, and most preferably, 0.01 µM or better. Antibodies specific only for a particular angiogenesis regulatory protein ortholog, such as human angiogenesis regulatory protein, can also be made, by subtracting out other cross-reacting orthologs from a species such as a non-human mammal. In this manner, antibodies that bind only to angiogenesis regulatory proteins may be obtained.

Once the specific antibodies against specific angiogenesis regulatory proteins are available, the proteins can be detected by a variety of immunoassay methods. In addition, the antibodies can be used therapeutically as a angiogenesis regulatory protein modulators. For a review of immunological and immunoassay procedures, see *Basic and Clinical Immunology* (Stites & Terr eds., 7$^{th}$ ed. 1991). Moreover, the immunoassays of the present invention can be performed in any of several configurations, which are reviewed extensively in *Enzyme Immunoassay* (Maggio, ed., 1980); and Harlow & Lane, supra.

B. Immunological Binding Assays

Angiogenesis regulatory proteins can be detected and/or quantified using any of a number of well recognized immunological binding assays (see, e.g., U.S. Pat. Nos. 4,366,241; 4,376,110; 4,517,288; and 4,837,168). For a review of the general immunoassays, see also *Methods in Cell Biology: Antibodies in Cell Biology*, volume 37 (Asai, ed. 1993); *Basic and Clinical Immunology* (Stites & Terr, eds., 7th ed. 1991). Immunological binding assays (or immunoassays) typically use an antibody that specifically binds to a protein or antigen of choice (in this case the angiogenesis regulatory proteins or antigenic subsequence thereof). The antibody (e.g., anti-angiogenesis regulatory protein) may be produced by any of a number of means well known to those of skill in the art and as described above.

Immunoassays also often use a labeling agent to specifically bind to and label the complex formed by the antibody and antigen. The labeling agent may itself be one of the moieties comprising the antibody/antigen complex. Thus, the labeling agent may be a labeled angiogenesis regulatory protein or a labeled anti-angiogenesis regulatory protein antibody. Alternatively, the labeling agent may be a third moiety, such a secondary antibody, that specifically binds to the antibody/angiogenesis regulatory protein complex (a secondary antibody is typically specific to antibodies of the species from which the first antibody is derived). Other proteins capable of specifically binding immunoglobulin constant regions, such as protein A or protein G may also be used as the label agent. These proteins exhibit a strong non-immunogenic reactivity with immunoglobulin constant regions from a variety of species (see, e.g., Kronval et al., *J. Immunol.* 111:1401-1406 (1973); Akerstrom et al., *J. Immunol.* 135:2589-2542 (1985)). The labeling agent can be modified with a detectable moiety, such as biotin, to which another molecule can specifically bind, such as streptavidin. A variety of detectable moieties are well known to those skilled in the art.

Throughout the assays, incubation and/or washing steps may be required after each combination of reagents. Incubation steps can vary from about 5 seconds to several hours, optionally from about 5 minutes to about 24 hours. However, the incubation time will depend upon the assay format, antigen, volume of solution, concentrations, and the like. Usually, the assays will be carried out at ambient temperature, although they can be conducted over a range of temperatures, such as 110° C. to 40° C.

Non-Competitive Assay Formats

Immunoassays for detecting angiogenesis regulatory proteins in samples may be either competitive or noncompetitive. Noncompetitive immunoassays are assays in which the amount of antigen is directly measured. In one preferred "sandwich" assay, for example, the anti-angiogenesis regulatory protein antibodies can be bound directly to a solid substrate on which they are immobilized. These immobilized antibodies then capture angiogenesis regulatory protein present in the test sample. Angiogenesis regulatory proteins thus immobilized are then bound by a labeling agent, such as a second angiogenesis regulatory protein-antibody bearing a label. Alternatively, the second antibody may lack a label, but it may, in turn, be bound by a labeled third antibody specific to antibodies of the species from which the second antibody is derived. The second or third antibody is typically modified with a detectable moiety, such as biotin, to which another molecule specifically binds, e.g., streptavidin, to provide a detectable moiety.

Competitive Assay Formats

In competitive assays, the amount of angiogenesis regulatory proteins present in the sample is measured indirectly by measuring the amount of a known, added (exogenous) angiogenesis regulatory proteins displaced (competed away) from an anti-angiogenesis regulatory protein antibody by the unknown angiogenesis regulatory proteins present in a sample. In one competitive assay, a known amount of angiogenesis regulatory proteins is added to a sample and the sample is then contacted with an antibody that specifically binds to angiogenesis regulatory proteins. The amount of exogenous angiogenesis regulatory proteins bound to the antibody is inversely proportional to the concentration of angiogenesis regulatory proteins present in the sample. In a particularly preferred embodiment, the antibody is immobilized on a solid substrate. The amount of angiogenesis regulatory proteins bound to the antibody may be determined either by measuring the amount of angiogenesis regulatory protein present in angiogenesis regulatory proteins/antibody complex, or alternatively by measuring the amount of remaining uncomplexed protein. The amount of angiogenesis regulatory proteins may be detected by providing a labeled angiogenesis regulatory protein molecule.

A hapten inhibition assay is another preferred competitive assay. In this assay the known angiogenesis regulatory proteins is immobilized on a solid substrate. A known amount of anti-angiogenesis regulatory protein antibody is added to the sample, and the sample is then contacted with the immobilized angiogenesis regulatory protein. The amount of anti-angiogenesis regulatory protein antibody bound to the known immobilized angiogenesis regulatory protein is inversely proportional to the amount of angiogenesis regulatory proteins present in the sample. Again, the amount of immobilized antibody may be detected by detecting either the immobilized fraction of antibody or the fraction of the antibody that remains in solution. Detection may be direct where the antibody is labeled or indirect by the subsequent addition of a labeled moiety that specifically binds to the antibody as described above.

Cross-Reactivity Determinations

Immunoassays in the competitive binding format can also be used for crossreactivity determinations. For example, angiogenesis regulatory proteins can be immobilized to a solid support. Proteins (e.g., angiogenesis regulatory protein and homologs) are added to the assay that compete for binding of the antisera to the immobilized antigen. The ability of the added proteins to compete for binding of the antisera to the immobilized protein is compared to the ability of the angiogenesis regulatory protein to compete with itself. The percent crossreactivity for the above proteins is calculated, using standard calculations. Those antisera with less than 10% crossreactivity with each of the added proteins listed above are selected and pooled. The cross-reacting antibodies are optionally removed from the pooled antisera by immunoabsorption with the added considered proteins, e.g., distantly related homologs.

The immunoabsorbed and pooled antisera are then used in a competitive binding immunoassay as described above to compare a second protein, thought to be perhaps an allele or polymorphic variant of a angiogenesis regulatory proteins, to the immunogen protein. In order to make this comparison, the two proteins are each assayed at a wide range of concentrations and the amount of each protein required to inhibit 50% of the binding of the antisera to the immobilized protein is determined. If the amount of the second protein required to inhibit 50% of binding is less than 10 times the amount of the angiogenesis regulatory proteins that is required to inhibit 50% of binding, then the second protein is said to specifically bind to the polyclonal antibodies generated to angiogenesis regulatory protein immunogen.

Other Assay Formats

Western blot (immunoblot) analysis is used to detect and quantify the presence of an angiogenesis regulatory protein in the sample. The technique generally comprises separating sample proteins by gel electrophoresis on the basis of molecular weight, transferring the separated proteins to a suitable solid support, (such as a nitrocellulose filter, a nylon filter, or derivatized nylon filter), and incubating the sample with the antibodies that specifically bind angiogenesis regulatory protein. The anti-angiogenesis regulatory protein antibodies specifically bind to the angiogenesis regulatory protein on the solid support. These antibodies may be directly labeled or alternatively may be subsequently detected using labeled antibodies (e.g., labeled sheep anti-mouse antibodies) that specifically bind to the anti-angiogenesis regulatory protein antibodies.

Other assay formats include liposome immunoassays (LIA), which use liposomes designed to bind specific molecules (e.g., antibodies) and release encapsulated reagents or markers. The released chemicals are then detected according to standard techniques (see Monroe et al., *Amer. Clin. Prod. Rev.* 5:34-41 (1986)).

Reduction of Non-Specific Binding

One of skill in the art will appreciate that it is often desirable to minimize non-specific binding in immunoassays. Particularly, where the assay involves an antigen or antibody immobilized on a solid substrate it is desirable to minimize the amount of non-specific binding to the substrate. Means of reducing such non-specific binding are well known to those of skill in the art. Typically, this technique involves coating the substrate with a proteinaceous composition. In particular, protein compositions such as bovine serum albumin (BSA), nonfat powdered milk, and gelatin are widely used with powdered milk being most preferred.

Labels

The particular label or detectable group used in the assay is not a critical aspect of the invention, as long as it does not significantly interfere with the specific binding of the antibody used in the assay. The detectable group can be any material having a detectable physical or chemical property. Such detectable labels have been well-developed in the field of immunoassays and, in general, most any label useful in such methods can be applied to the present invention. Thus, a label is any composition detectable by spectroscopic, photochemical, biochemical, immunochemical, electrical, optical or chemical means. Useful labels in the present invention include magnetic beads (e.g., DYNABEADS™), fluorescent dyes (e.g., fluorescein isothiocyanate, Texas red, rhodamine, and the like), radiolabels (e.g., $^3$H, $^{125}$I, $^{35}$S, $^{14}$C, or $^{32}$P), enzymes (e.g., horse radish peroxidase, alkaline phosphatase and others commonly used in an ELISA), and calorimetric labels such as colloidal gold or colored glass or plastic beads (e.g., polystyrene, polypropylene, latex, etc.).

The label may be coupled directly or indirectly to the desired component of the assay according to methods well known in the art. As indicated above, a wide variety of labels may be used, with the choice of label depending on sensitivity required, ease of conjugation with the compound, stability requirements, available instrumentation, and disposal provisions.

Non-radioactive labels are often attached by indirect means. Generally, a ligand molecule (e.g., biotin) is covalently bound to the molecule. The ligand then binds to another molecules (e.g., streptavidin) molecule, which is either inherently detectable or covalently bound to a signal system, such as a detectable enzyme, a fluorescent compound, or a chemiluminescent compound. The ligands and their targets can be used in any suitable combination with antibodies that recognize angiogenesis regulatory proteins, or secondary antibodies that recognize anti-angiogenesis regulatory protein.

The molecules can also be conjugated directly to signal generating compounds, e.g., by conjugation with an enzyme or fluorophore. Enzymes of interest as labels will primarily be hydrolases, particularly phosphatases, esterases and glycosidases, or oxidotases, particularly peroxidases. Fluorescent compounds include fluorescein and its derivatives, rhodamine and its derivatives, dansyl, umbelliferone, etc. Chemiluminescent compounds include luciferin, and 2,3-dihydrophthalazinediones, e.g., luminol. For a review of various labeling or signal producing systems that may be used, see U.S. Pat. No. 4,391,904.

Means of detecting labels are well known to those of skill in the art. Thus, for example, where the label is a radioactive label, means for detection include a scintillation counter or photographic film as in autoradiography. Where the label is a fluorescent label, it may be detected by exciting the fluorochrome with the appropriate wavelength of light and detecting the resulting fluorescence. The fluorescence may be detected visually, or by the use of electronic detectors such as charge coupled devices (CCDs) or photomultipliers and the like. Similarly, enzymatic labels may be detected by providing the appropriate substrates for the enzyme and detecting the resulting reaction product. Finally simple calorimetric labels may be detected simply by observing the color associated with the label. Thus, in various dipstick assays, conjugated gold often appears pink, while various conjugated beads appear the color of the bead.

Some assay formats do not require the use of labeled components. For instance, agglutination assays can be used to detect the presence of the target antibodies. In this case, antigen-coated particles are agglutinated by samples comprising the target antibodies. In this format, none of the components need be labeled and the presence of the target antibody is detected by simple visual inspection.

Gene therapy

The present invention provides the nucleic acids of angiogenesis regulatory protein for the transfection of cells in vitro and in vivo. These nucleic acids can be inserted into any of a number of well-known vectors for the transfection of target cells and organisms as described below. The nucleic acids are transfected into cells, ex vivo or in vivo, through the interaction of the vector and the target cell. The nucleic acid, under the control of a promoter, then expresses the angiogenesis regulatory proteins of the present invention, thereby mitigating the effects of absent, partial inactivation, or abnormal expression of the angiogenesis regulatory protein gene, particularly as it relates to angiogenesis. The compositions are administered to a patient in an amount sufficient to elicit a therapeutic response in the patient. An amount adequate to accomplish this is defined as "therapeutically effective dose or amount."

Such gene therapy procedures have been used to correct acquired and inherited genetic defects, cancer, and other diseases in a number of contexts. The ability to express artificial genes in humans facilitates the prevention and/or cure of many important human diseases, including many diseases which are not amenable to treatment by other therapies (for a review of gene therapy procedures, see Anderson, *Science* 256:808-813 (1992); Nabel & Felgner, TIBTECH 11:211-217 (1993); Mitani & Caskey, TIBTECH 11:162-166 (1993); Mulligan, *Science* 926-932 (1993); Dillon, TIBTECH 11:167-175 (1993); Miller, *Nature* 357:455-460 (1992); Van Brunt, *Biotechnology* 6(10):1149-1154 (1998); Vigne, *Restorative Neurology and Neuroscience* 8:35-36 (1995); Kremer & Perricaudet, *British Medical Bulletin* 51(1):31-44 (1995); Haddada et al., in *Current Topics in Microbiology and Immunology* (Doerfler & Böhm eds., 1995); and Yu et al., *Gene Therapy* 1:13-26 (1994)).

The nucleic acids of the invention can also be used to make transgenic animals, such as transgenic mice, either by knockout or overexpression. Such animals are useful, e.g., for testing modulators of angiogenesis.

Pharmaceutical Compositions and Administration

Pharmaceutically acceptable carriers are determined in part by the particular composition being administered (e.g., nucleic acid, protein, modulatory compounds or transduced cell), as well as by the particular method used to administer the composition. Accordingly, there are a wide variety of suitable formulations of pharmaceutical compositions of the present invention (see, e.g., *Remington's Pharmaceutical Sciences*, 17$^{th}$ ed., 1989). Administration can be in any convenient manner, e.g., by injection, oral administration, inhalation, transdermal application, or rectal administration.

Formulations suitable for oral administration can consist of (a) liquid solutions, such as an effective amount of the packaged nucleic acid suspended in diluents, such as water, saline or PEG 400; (b) capsules, sachets or tablets, each containing a predetermined amount of the active ingredient, as liquids, solids, granules or gelatin; (c) suspensions in an appropriate liquid; and (d) suitable emulsions. Tablet forms can include one or more of lactose, sucrose, mannitol, sorbitol, calcium phosphates, corn starch, potato starch, microcrystalline cellulose, gelatin, colloidal silicon dioxide, talc, magnesium stearate, stearic acid, and other excipients, colorants, fillers, binders, diluents, buffering agents, moistening agents, preservatives, flavoring agents, dyes, disintegrating agents, and pharmaceutically compatible carriers. Lozenge forms can comprise the active ingredient in a flavor, e.g., sucrose, as well as pastilles comprising the active ingredient in an inert base, such as gelatin and glycerin or sucrose and acacia emulsions, gels, and the like containing, in addition to the active ingredient, carriers known in the art.

The compound of choice, alone or in combination with other suitable components, can be made into aerosol formulations (i.e., they can be "nebulized") to be administered via inhalation. Aerosol formulations can be placed into pressurized acceptable propellants, such as dichlorodifluoromethane, propane, nitrogen, and the like.

Formulations suitable for parenteral administration, such as, for example, by intraarticular (in the joints), intravenous, intramuscular, intradermal, intraperitoneal, and subcutaneous routes, include aqueous and non-aqueous, isotonic sterile injection solutions, which can contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. In the practice of this invention, compositions can be administered, for example, by intravenous infusion, orally, topically, intraperitoneally, intravesically or intrathecally. Parenteral administration and intravenous administration are the preferred methods of administration. The formulations of commends can be presented in unit-dose or multi-dose sealed containers, such as ampules and vials.

Injection solutions and suspensions can be prepared from sterile powders, granules, and tablets of the kind previously described. Cells transduced by nucleic acids for ex vivo therapy can also be administered intravenously or parenterally as described above.

The dose administered to a patient, in the context of the present invention should be sufficient to effect a beneficial therapeutic response in the patient over time. The dose will be determined by the efficacy of the particular vector employed and the condition of the patient, as well as the body weight or surface area of the patient to be treated. The size of the dose also will be determined by the existence, nature, and extent of any adverse side-effects that accompany the administration of a particular vector, or transduced cell type in a particular patient.

In determining the effective amount of the vector to be administered in the treatment or prophylaxis of conditions owing to diminished or aberrant expression of the angiogenesis regulatory proteins, the physician evaluates circulating plasma levels of the vector, vector toxicities, progression of the disease, and the production of anti-vector antibodies. In general, the dose equivalent of a naked nucleic acid from a vector is from about 1 µg to 100 µg for a typical 70 kilogram patient, and doses of vectors which include a retroviral particle are calculated to yield an equivalent amount of therapeutic nucleic acid.

For administration, compounds and transduced cells of the present invention can be administered at a rate determined by the LD-50 of the inhibitor, vector, or transduced cell type, and the side-effects of the inhibitor, vector or cell type at various concentrations, as applied to the mass and overall health of the patient. Administration can be accomplished via single or divided doses.

EXAMPLES

Using a functional assay described herein (see also FIG. 1), angiogenesis regulatory proteins and nucleic acids have been identified and cloned from a green fluorescent protein (GFP) fusion cDNA retroviral library. The cDNAs can be in-frame, our of frame, sense, or antisense. Primary endothelial cells were transduced with retroviral cDNA/GFP fusion libraries. Transduced cells were selected and assayed for alterations consistent with inhibition of angiogenesis, e.g. downregulation of cell surface expression of αvβ3 or downregulation of haptotaxis.

All publications and patent applications cited in this specification are herein incorporated by reference as if each individual publication or patent application were specifically and individually indicated to be incorporated by reference.

Although the foregoing invention has been described in some detail by way of illustration and example for purposes of clarity of understanding, it will be readily apparent to one of ordinary skill in the art in light of the teachings of this invention that certain changes and modifications may be made thereto without departing from the spirit or scope of the appended claims.

SEQUENCE LISTING (522 sequences)

SEQ ID NO: 1 - DNA, 758 bp, Homo sapiens
  modified_base (1)...(758): n = g, a, c or t
atgtagaacatgcgctggggtgggggcttgtagagcacaccaccgtacgtgggccagagcccacccaggatccggaatagggagctcttgccgcagccattggggcctgtgatgagcagatgcatgcctatcctccacctgatgttgaggctggggcaccacaactctcctganggcgtgaacgaatcgggaatgtttccatcccgtgcgaaggaagtctnngtgtcgacgcgctctcgnctcatcacaacactccaacaaacacgtgggctcggaatcttcaaggggggggccatccagaaaacagcgaacaaaccactgaacctggggcgtagatgaggctcncacccaagataaaacaccccggggcgccttgggaagacccgggtctcccgtcccttaanacgttctccccatgtggcggggcccactcccttcttggtnacaacnggcttggcaccaagaccaggccgctcgcaacaccgcagtccgcgtttttctcagacagcaaagtttancncccctttgtaggaagaaaacccaaagagtttccgattccacaggagtttgggccgcaatgcaacagncccaggagcggggnngccgcacttcgagtctagcggatttatatatagacacgccgcaactagngagcgtcccctcgaaaagagcccnagnttacacncccggggggtatccggtcaaaagcagcccnttaccctccccttnttttggtggttaataccggcggaaaaaac

SEQ ID NO: 2 - DNA, 3643 bp, Homo sapiens
ggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtgccaaagaggggtcaccagggggagctgtctgcggagccagcgcctgcccgagagagaccccaccgccaccgtgtgcctttcccgggccctcagccctcgggccgggcaccacccccagtccccccagtaaaagcctccactggcaaaaaaaaaaaaaaaaaaaa

SEQ ID NO: 3 - DNA, 3616 bp, Homo sapiens
gcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgcggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtgccaaagaggggtcaccagggggagctgtctgcggagccagcgcctgcccgagagagaccccaccgccaccgtgtgcctttcccgggccctcagccctcgggccgggcaccacccccagtccccccagtaaa

SEQ ID NO: 4 - protein, 745 aa, Homo sapiens [sequence omitted]

SEQ ID NO: 5 - DNA, 368 bp, Homo sapiens
  modified_base (1)...(368): n = g, a, c or t
gctgcggatcaacatctcggaggggaattgtccggagagaatcatcacatcatgaccggccccaccaatgccatctttaagagctttcgctatgatcatcgacaagactggaggaagatatcaacagctccatgaccaacagtaccgcggcacagcaggccccacgggtcaccctgaggctggatggtgccggccacccagatgcggctccctgatangggaaaggcgggtgtaagatcaaagagatcannagagagtacggggngcgcaggtccaaggaatggcaggagggatatgcatgcccaaaaacaaccgagacgggccaaanaccatagctggacagtgccgaaggactgtcaccngaagat

SEQ ID NO: 6 - DNA, 472 bp, Homo sapiens
  modified_base (1)...(472): n = g, a, c or t
cgctgcggcctcccgcccgctcccgctcgctcccgcggcctcgctcgcctcgcgccggcagttttgggcctacacctcccctccccccgccagccgccaaagacttgaccacgtaacgagcccaactcccccgaacgccgccgccgctcgccatggatgccggtgtgactgaaagtggactaaatgtgactctcaccattcggcttcttatgcacggaaaggaagtaggaagcatcattgggaagaaaggggagtcggtataagaggatccgcgaggagagtggngcgcggatcaacatctcggaggggaatttgtaccggagagaatcatcactctgaccggcncccaacaaatgcacaancntaaaggacntaaacgacaaatagaatcatacgacaaanctagagagaagatatcaacagactccaatgaacaaaanaaaccgcagagacagacaggaaccccnggaac

SEQ ID NO: 7 - DNA, 295 bp, Homo sapiens
cttgaatcgagtaggcatccagaggtggtccctccaggtcatgggtggcatgggggtagcccgcagcgtcgctgcaccgatcttggccgcccgcgcagatgactggggagctggccggcatgggctggtacggaatggtcatgactctccacttggcggagacctgggcagaggccggttctcccagggcaatgaccccaggcaaatctgcttgagacacacctacggtgcacagactggcggggcaacggcacagagcagaagttgcggtgaacagctgggcacacaaggacga

SEQ ID NO: 8 - DNA, 374 bp, Homo sapiens
catggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaagactttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcg

SEQ ID NO: 9 - DNA, 885 bp, Homo sapiens
  modified_base (1)...(885): n = g, a, c or t
agaggcgcagcggtcgcagcgntggctcagtgtgctgggttcttgcggcttgaatcgagtaggcatccagaggtggtccctccaggtcatgggtggcatgggggtagcccgcagcgtcgctgcaccgatcttggcgcccgcgcagatgactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagtttgggcagcatatcccccgcaactggacctgcgcccccgtactctcgcggatctctttgatcttacacccgcctttcccaatcagtggagccgcactgggtgggcggcaacaacagctcagggtgaccgggggcctgctggccgcggtactgtttggtcatggagctgttgatatcttcctccagcttgtcgatgatcatagcgaaagccttaaagatggcattggtggggccggtcagagtgatgattctctccggacaattcccctccgagatgtttgatccgggcgccactctcctcgcggatcctcttaacgaatcccctttcttcccaatgatgcttctacttcctttccgtgcataggaagccgaatggtgagagtcacattttagtccacttttcagtcacaccggggatccatggncgancgggcggggacgggcgtacgggggaattgggctcgtaacagttggnccagntcnttaggcggtgagagggagggaagggaggccaacaatggcggggagaagaaggcacgacaacagagtgcggaggacaaccaacacaacaaggtaaaaaa

SEQ ID NO: 10 - DNA, 715 bp, Homo sapiens
  modified_base (1)...(715): n = g, a, c or t
cttgaatcgagtaggcatccagagngtggtccctccaggtcatgggtggcatgggggtagcccgcagcgtcgctgcaccgatcttggccgcccgcgtagatgactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggngagagttagggcacgcaatatccccacgaacaaactggaactgacggcccccgaaactctacgcnagatactcnttaagaaacttnacacccggacttatacccaaatcagagaagccgcaacatgggtggcaccggaaaacaacagaactccaggggatgaaccggaggggacatagaaagggaacagacggggataccataggtctggcggtcccaatggggaggcctgcntatgaactaaatccttacccttcccaancacataggnatccggaatggaaatcaaataggcggaaaaangtccctttaaaacagaaaatngggcaacttngnaagggggggaccacgagacanaacaaaccgaagacatacgcaaccagggaacaaaanttaccccgacacgcagagaaggntggacancacggcacagaccacagtacccatcnnagacggacaccg

SEQ ID NO: 11 - DNA, 643 bp, Homo sapiens
  modified_base (1)...(643): n = g, a, c or t
cttgaatcgagtaggcatccagaggtggtccctccaggtcatgggtggcatgggggtagcccgcagcgtcgctgcaccgatcttggccgcccgcgcagatgactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatcccccgcacacctggacctgcgcccccgtactctcgcggatctcttatgatcttaacaacacacgacacntttttcncancaaaatccagggagccgacaacatggagtgagcccggacaccacacagacctcagggtgaccgggggcctgcatggccgacggatacngaanggtcatggacgctgtgatatcttcctccagctagtcgatgatcatagcgaaaagcccctttcacaacgaaatgaggccattngagatnggggcggcccgggatccaggaaggttcgcactaggaactnacgtaccattatccccagggagaaaacnccagaacaatattacacccacccaccgattaccccaagaaagaaa

SEQ ID NO: 12 - DNA, 544 bp, Homo sapiens
  modified_base (1)...(544): n = g, a, c or t
cttgaatcgagtaggcatccagaggtggtccctccaggtcatgggtggcatgggggtagcccgcagcgtcgctgcgccgatcttggccgcccgcgcagatgactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatccccacgagcanctggacctgcgcccccgatactctcgacggatctctttgatcttacacccgacctttcccaatcagggaagccgcacatgggatggcacggcaccaccagacctcagggatgaccagggaggcctgcatggaccgcaggatactgataggatcatggagnctgatagatatcttccctccagactatgntcgatgatcaataaggcggaaaaggccataaanagnaatgggcaattagggatcgggaggaccaggatcaaga

SEQ ID NO: 13 - DNA, 505 bp, Homo sapiens
  modified_base (1)...(505): n = g, a, c or t
cttgaatcgagtaggcatccagaggtggtccctccaggtcagtaatggccgggttttttgggtnggggcccaaattttcgggggaaggagtaaaggcccccaccgggaccaattggcagggtccgctgcnaccgatacttggcctgccgcgcagatgactggggagctggtcggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatcccccgccacctggacctgcgcccccgtactctcgcggatctctttgatcttacacccgcctttcccaatcagggagccgcactgggtggccggcaccaccagcctcagggtgaccgggggcctgctggccgcggtactgttggtcatggggctgttgatatcttcctccagcttgtcg

SEQ ID NO: 14 - DNA, 431 bp, Homo sapiens
cttgaatcgagtaggcatccagaggtggtccctccaggtcatgggtggcatgggggtagcccgcagcgtcgctgcaccgatcttggccgcccgcgcagatactggggagctggccggcatgggctggtacggaatggtcatgactctcccttgcggagactgggagagcgtctccagcatgaccaggcaaatctgcttgacaccctcggtgacagactgcggcacgccagcgatggtgatggcccgctcggtggagttgggcagcatatcccccgccacctggacctgcgcccccgtactctcgcggatctctttgatcttacacccgcctttcccaatcagggagccgcactgggtggccggcaccaccagcctcagggtgaccgggggcctgctggccgcggtactgttggtcatggagctgttgatat

SEQ ID NO: 15 - DNA, 614 bp, Homo sapiens
agcttggtacgagctcggatcactagtaacggccgccagtgtgctggaattcgcccttcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagggtgtcaagcagatttgcctggtcatgctggagacgctctcccagtctccgcaagggagagtcatgaccattccgtaccagcccatgccggccagctccccagtatctgcgcgggcggccaagatcggtgcagcgacgctgcgggctacccccatgccacccatgacctggagggaccacctctggatgcctactcgattcaag

SEQ ID NO: 16 - DNA, 619 bp, Homo sapiens
cttgaatcgagtaggcatccagaggtggtccctccaggtcatgggtggcatgggggtagcccgcagcgtcgctgcaccgatcttggccgcccgcgcagatactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatcccccgccacctggacctgcgcccccgtactctcgcggatctctttgatcttacacccgcctttcccaatcagggagccgcactgggtggccggcaccaccagcctcagggtgaccgggggcctgctggccgcggtactgttggtcatggagctgttgatatcttcctccagcttgtcgatgatcatagcgaaagccttaaagatggcattggtggggccggtcagagtgatgattctctccggacaattcccctccgagatgttgatccgcgcgccatctcctcgcggatcctcttaaaccgatcccctttcttcccaatgatgcttctacttctttccgtgcatagaa

SEQ ID NO: 17 - DNA, 382 bp, Homo sapiens
cttgaatcgagtaggcatccagaggtggtccctccaggtcatgggtggcatgggggtagcccgcagcgtcgctgcaccgatcttggccgcccgcgcagatactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatcccccgccacctggacctgcgcccccgtactctcgcggatctctttgatcttacacccgcctttcccaatcagggagccgcactgggtggccggcaccaccagcctcagggtg

SEQ ID NO: 18 - DNA, 566 bp, Homo sapiens
cttgaatcgagtaggcatccagaggtggtccctccaggtcatgggtggcatgggggtagcccgcagcgtcgctgcaccgatcttggccgcccgcgcagatactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatcccccgccacctggacctgcgcccccgtactctcgcggatctctttgatcttacacccgcctttcccaatcagggagccgcactgggtggccggcaccaccagcctcagggtgaccgggggcctgctggccgcggtactgttggtcatggagctgttgatatcttcctccagcttgtcgatgatcatagcgaaagccttaaagatggcattggtggggccggtcagagtgatgattctctccggacaattcccctccgagatgttgatccgcgcgccactctcctcgcggatcctct

SEQ ID NO: 19 - DNA, 643 bp, Homo sapiens
cttgaatcgagtaggcatccagaggtggtccctccaggtcatgggtggcatgggggtagcccgcagcgtcgctgcaccgatcttggccgcccgcgcagatactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatcccccgccacctggacctgcgcccccgtactctcgcggatctctttgatcttacacccgcctttcccaatcagggagccgcactgggtggccggcaccaccagcctcagggtgaccgggggcctgctggccgcggtactgttggtcatggagctgttgatatcttcctccagcttgtcgatgatcatagcgaaagccttaaagatggcattggtggggccggtcagagtgatgattctctccggacaattcccctccgagatgttgatccgcgcgccactctcctcgcggatcctcttaaccgactcccctttcttcccaaatgatgcttcctacttcccttttccgtgcataagaaagccgaaatggtgagag

SEQ ID NO: 20 - DNA, 370 bp, Homo sapiens
  modified_base (1)...(370): n = g, a, c or t
nngctgcggatcaacatctcggaggggaattgtccggagagaatcatcacatcatgaccggccccaccaatgccatctttaagagctttcgctatgatcatcgacaagactggaggaagatatcaacagctccatgaccaacagtaccgcggcacagcaggccccacgggtcaccctgaggctggatggtgccggccacccagatgcggctccctgatangggaaaggcgggtgtaagatcaaagagatcannagagagtacggggngcgcaggtccaaggaatggcaggagggatatgcatgcccaaaaacaaccgagacgggccaaanaccatagctggacagtgccgaaggactgtcaccngaagat

SEQ ID NO: 21 - DNA, 319 bp, Homo sapiens
cttgaatcgagtaggcatccagaggtggtccctccaggtcatgggtggcatgggggtagcccgcagcgtcgctgcaccgatcttggccgcccgcgcagatgactggggagctggccggcatgggctggtacggaatggtcatgactctcccttgcgggagaactggggaagagcgtctccagcatgaccaggcaaatctgcttgacacactcggtgacagactgcggcacgccagcaatggtgatggcccgctcggtggagttgggcagcatatcccccgccacctggacctgcgcccccgtactctcgcggatctctt

SEQ ID NO: 22 - DNA, 264 bp, Homo sapiens
  modified_base (1)...(264): n = g, a, c or t
ggcgccagtgtgctgcnattcgcntatctctcggcatggacgagctggtacaaaaaggaggagggcccgcaagtcggtggcagcggtggctccagtgttggctgggggggttctgcggcttgaatcggaaggtttaagggggcatccagaggtggtccctccaggtcatgggtggcatgggggtagcccgcagcgtcgctgcaccgatcttggcgccgcgccagatgactgggggaagctggccggcatgggcttggtacggaa

SEQ ID NO: 23 - DNA, 626 bp, Homo sapiens
  modified_base (1)...(626): n = g, a, c or t
cgctgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaaagatcggngcagcgacgctgcgggctaccccacaatagacacaccatgacctggagggaacaactactggatgctacatccganntcaagccggaaaaanccaacaaactgggaaccacacgatagacacacgtcgccttggcaggcatcaccacctatgaa

SEQ ID NO: 24 - DNA, 849 bp, Homo sapiens
  modified_base (1)...(849): n = g, a, c or t
cttgaatcgagtaggcatccagaggtggtccctccaggtcatgggtggcatgggggtagcccgcagcgtcgctgcaccgatcttggccgcccgcgcagatgactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatcccccgccacctggacctgcgcccccgtactctcgcggatctctttgatcttacacccgcctttcccaatcagggagccgcactgggtggccggcaccaccagcctcagggtgaccgggggcctgctggccgcggtactgttggtcatggagctgttgatatcttcctccagacttgtcgatgatcatagcgaaagccttaaaagatggcattggtgggggccggtcagagtgatgattctctccggacaattccccttcgaagatgtgatccgcgcgcacatctcctcgcggatctcttaaaccgagtcccntttcatccaagaatgnactcctactccctataccggccataanaangccgaaatgggtgaagaangtcacactttaaggtccacacttatcagcacancccgggatccacaggggcaaacggccgggagcaggaaggcccgagaggcccggaaaaacccanacaacagggttaaataaaaataaagggccgcaaaaaaatcgaaggaatcgagaaaaacangccgccaaatcggcacactaatgaacgataacaactaaagacaga

SEQ ID NO: 25 - DNA, 360 bp, Homo sapiens
  modified_base (1)...(360): n = g, a, c or t
cgctgcgggctcccggcccggctcgccatggatggccggtgtgactgaaagtggactaaatgtgantctcaccattcggcttcttatgcacggaaaggaagtaggaagcatcattgggaagaaaggggagtcngttaagangatccgtgaggagagtggcgcgcggatcaactatctcgtgagggaattgtcncggagagaancatcactctgaccggccccaccaatgancanctttaaggcttgcgcatatgatcatcgacaagcnggaggaagatatcaacagantaccatgaccaacagtaccgcgggacagacangcccccggncagacangaggctggaggnagccggaccagc

SEQ ID NO: 26 - DNA, 744 bp, Homo sapiens
  modified_base (1)...(744): n = g, a, c or t
cttgaatcgagtaggcatccagaggtggtccctccaggtcatgggtggcatgggggtagcccgcagcgtcgctgcaccgatcttggccgcccgcgcagatgactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatcccccgcactggacctgcgcccccgtactctcgcggatctctttgatcttacacccgcctttcccaatcagggagccgcactgggtgtgccggcaccaccagcctcagggtgaccgggggcctgctggccgcggtactgttggtcatggagctgttgatatcttcctccagcttgtcgatgatcatagcgaaagccttaaagatggcattggtggggccggtcagagtgatgattctctccggacaattcccctccgagatgttgatccgcgcgccactctcctcgcggatcctcttaaacgatcccctttcttcccaatgatgcttccatacttcctttccgtgcataagaagccgaaatggtgagagtcaccatttaggtccactttcagtcaacaccggatccatgggcgagcgggggcaggacgtaccggggngagattgggctcgaacagtgggcaaagacaggacaga

SEQ ID NO: 27 - DNA, 554 bp, Homo sapiens
  modified_base (1)...(554): n = g, a, c or t
cgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaatttgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtngccggccacccagtgcggctccctgattgggaaaggcgggtgtaagatcaaagagatccgcgagagtacgggggcgcaggtccaggt

SEQ ID NO: 28 - DNA, 553 bp, Homo sapiens
cgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacggggggcgcaggtccaggg

SEQ ID NO: 29 - DNA, 801 bp, Homo sapiens
  modified_base (1)...(801): n = g, a, c or t
cgctgcggcctcccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgccaactccaccgagcgggccatcaccatcgctggcgtgccgcagtctgttcaccgaagtgtgtcacagcnagatttgcctggtcatgcttggaaaacggcttctccccaantaccttccngcaaaggggagaagtccattgaacccanttccccgcgnaaccaacagcccccaaatgggcccggggccacaggctccccccaaggacanatcnggaggccggggggacgggcccaacgaatccggggaggcaagacgaanacatgcagggcataaccccccanggcacacccatgaacctgggaaggggaccacctctgggaatggcnaatcgagtcaagccagaaaaaccagcacacg

SEQ ID NO: 30 - DNA, 827 bp, Homo sapiens
  modified_base (1)...(827): n = g, a, c or t
cttgaatcgagtaggcatccagaggtggtccctccaggtcatgggtggcatgggggtagcccgcagcgtcgctgcaccgatcttggcgccgcgcagatgactggggagctggccggcatgggctggtacggaatggtcatgactctcccttgcggagactgggagagcgtctccagcatgaccaggcaaatctgcttgacacactcggtgacagactgcggcacgccagcgatggtgatgngcccgctcggtggagttgggcagcatatcccccggcacctgganctgcgcccccgtactctcgcggatctctttgatcttacacccgcctttcccaatcagtggagccgcactgggtgtgcctggcaccaccagcctcagggtgaccggggtgcctgctggccgcggtactgtttggtcatggagctgttgatatcttcctccagcttgtcgatgatcatagcgaaagccttaaagatggcattggtggggccggtcagagtgatgattctctccggacaattccctccgagatgttgatccgcgcgccaatctcctcgcggatcctcttaacgaatcccctttcttccaaangatgattcctanttcctttaccgtgcatatagaaagcccgaaatggttgacgagtccacatttagtccacactttcagtcacacccgggaatccaatgggcgagcggagggacggagacggggggaagatgggcgccgaacgttgggccaagaatagagcaagagagnagaaggaaaaangacaaagagcacaaacagaaaaaagacaaaaaggnagcaagcacacnaaaaaa

SEQ ID NO: 31 - DNA, 393 bp, Homo sapiens
cgctgcggcctcccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggacacccagtgcggctccctgattgggaaaggcgggatgtaagatcaaag

SEQ ID NO: 32 - DNA, 1634 bp, Homo sapiens
gacgccgcccgaccctgcgactacgctgcggactcccgcccgctcccgctcgctcccgcggtcctcgctcgcctcgcgccggtagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgtgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaatgcttcatatttgaaaaagctgggaattgctgtctt

SEQ ID NO: 33 - protein, 356 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAVGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 34 - DNA, 482 bp, Homo sapiens
ctcgcccggtgaagacgaagtgcgctcaagcgctccagtgcccaacgccagcgcacccccggcccccgacacccccagtcccacgccacgccgccaccacggcaccacttacaacaacggttgctcaagcagcggcaccttgtcccgggaaccgcagtagccgcctgctgccgcgccttggtcctcgatggaggccagcgccaggcccccgttggcggtggctccgccgctcgagccccttggagtctcgaggaggatcggccaccatgatggaagcaccggggtttcttagcgcctggaagctggctgggagcgcttgggctccttcccaggacccgacgttcctaggactgagttgagtaacagcacctggagactggaactttggagggctccttagagttgtgagttcacagcactaagttccttggctcttggaagctggagtgtttaaattccccaggctgggcgctaggcttctc

SEQ ID NO: 35 - DNA, 558 bp, Homo sapiens
ctcgcccgggaagacgaaggcgctcaagcgctccaggcccaacgccagcgcacccccggcccccgacacccccagtcccagcgccacgccggccaccacggccaccactgtcagcagcacaagcaggttggctcgaaggcagcggcgcacctggtcccgggaaccgcagtagccgcctgctgccgcgccttggtcctcgatggaggccagcgccaggcccccgttggcggtgggctccgccgctgcgagccccttggagtctcgaggaggatcggccaccatgatgggaagcaccggggtttcttagcgcctggaagctggctgggagcgcttgggctccttcccaggacccgacgttcctaggactgagttgagtaacagcacctggagactggaactttggagggctccttagagttgtgagttcacagcactgaagttccttggctcttggaagctggagtgtttaaattccccaggctgggcgctgaggcttctctgctctgccccgtgtgccagatgtccgaaagctgggagttcggagcgcccgggtttcct

SEQ ID NO: 36 - DNA, 595 bp, Homo sapiens
ctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcctggagcgcttgagcgccttcgtcttcccgggcgagccggaacccagcacactggagccacc

SEQ ID NO: 37 - DNA, 724 bp, Homo sapiens
ctatagggcgaatgggccctctagatgcatgctcgagcggccgccagtgtgatggatatctgcagaattcgcccttctctcggcatggacgagctgtacaaggaggaggccgccaaggccggtggcagcggtggctccagtgtgctgggttccggctcgcccgggaagacgaaggcgctcaagcgctccaggcccaacgccagcgcacccccggtccccgacacccccagtcccagcgccacgccggccaccacggccaccactgtcagcagcacaagcaggttggctcgaaggcagcggcgcacctggtcccgggaaccgcagtagccgcctgctgccgcgccttggtcctcgatggaggccagcgccaggcccccgttggcggtgggctccgccgctgcgagccccttggagtctcgaggaggatcggtcaccatgatgggaagcaccggggtttcttagcgcctggaagctggctgggagcgcttgggctccttcccaggacccgacgttcctaggactgagttgagtaacagcacctggagactggaactttggagggctccttagagttgcgagttcacagcactgaagttccttggctcttggaagctggagtgtttaaattccccaggctgggcgctgaggcttctctgctctgccccgtgtgccagatgtccgaaagctgggagttcggagcgcccgggttccttggccctaggag

SEQ ID NO: 38 - DNA, 681 bp, Homo sapiens
ctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcgcaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtgaccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcggggaccgggggtgcgctggcgttgggcctggagcgcttgagcgccttcgtcttcccgggcgagccggaacccagcacactggagccaccgctgccaccggccttggcggcctcctccttgtacagctcgtccatgccgagagaagggcgaattctgcagatatccatcacactgg

SEQ ID NO: 39 - DNA, 614 bp, Homo sapiens
ctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcctggagcgcttgagcgccttcgtcttcccgggcgagccggaacccagcacactggagccaccgctgccaccggccttggcg

SEQ ID NO: 40 - DNA, 689 bp, Homo sapiens
gatcactagtaacggccgccagtgtgctggaattcgcccttctctcggcatggacgagctgtacaaggaggaggccgccaaggccggtggcagcggtggctccagtgtgctgggttccggctcgcccgggaagacgaaggcgctcaagcgctccaggcccaacgccagcgcacccccggcccccgacacccccagtcccagcgccacgccggccaccacggccaccactgtcagcagcacaagcaggttggctcgaaggcagcggcgcacctggtcccgggaaccgcagtagccgcctgctgccgcgccttggtcctcgatggaggccagcgccaggcccccgttggcggtgggctccgccgctgcgagccccttggagtctcgaggaggatcggccaccatgatgggaagcaccggggtttcttagcgcctggaagctggctgggagcgcttgggctccttcccaggacccgacgttcctaggactgagttgagtaacagcacctggagactggaactttggagggctccttagagttgtgagttcacagcactgaagttccttggctcttggaagctggagtgtttaaattccccaggctgggcgctgaggcttctctgctctgccccgtgtgccagatgtccgaaagctgggagttcggagcgcccgggttccttggccctaggag

SEQ ID NO: 41 - DNA, 730 bp, Homo sapiens
actatagggcgaattgggccctctagatgcatgctcgagcggccgccagtgtgatggatatctgcagaattcgcccttctctcggcatggacgagctgtacaaggaggaggccgccaaggccggtggcagcggtggctccagtgtgctgggttccggctcgcccgggaagacgaaggcgctcaagcgctccaggcccaacgccagcgcacccccggcccccgacacccccagtcccagcgccacgccggccaccacggccaccactgtcagcagcacaagcaggttggctcgaaggcagcggcgcacctggtcccgggaaccgcagtagccgcctgctgccgcgccttggtcctcgatggaggccagcgccaggcccccgttggcggtgggctccgccgctgcgagccccttggagtctcgaggaggatcggccaccatgatgggaagcaccggggtttcttagcgcctggaagctggctgggagcgcttgggctccttcccaggacccgacgttcctaggactgagttgagtaacagcacctggagactggaactttggagggctccttagagttgtgagttcacagcactgaagttccttggctcttggaagctggagtgtttaaattccccaggctgggcgctgaggcttctctgctctgccccgtgtgccagatgtccgaaagctgggagttcggagcgcccgggttccttggccctaggagccgc

SEQ ID NO: 42 - DNA, 684 bp, Homo sapiens
  modified_base (1)...(684): n = g, a, c or t
ctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcctggagcgcttgagcgccttcgtcttcccgggcgagccggaacccagcacactggagccaccgctgccaccggccttggcggcctcctccttgtacagctcgtccatgccgagagaagggcgaattctgcagatatncatcacactggcgg

SEQ ID NO: 43 - DNA, 2856 bp, Homo sapiens
gtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattatgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaaaaaaaaaaaaaaaaa

SEQ ID NO: 44 - protein, 541 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 45 - DNA, 781 bp, Homo sapiens
  modified_base (1)...(781): n = g, a, c or t
acgcaggacgctctcgctgaacttcttgctcttgcctataacgcggttccgcgaggggactttggggcgggccagcgccccggccccctgcccgggcccccgccgcagcgccctttgtcgatcaccttcaggtcaggatgatgcggtccgcttgggcatcccgcgncttacaccttgcggttgatgatgcgcaccgtctccgagaagggcgaaatgaggcgggcagcagtccggggctgcccccctgcagggtccgggcgggggcaggggacggcgggacatacggttgggcaagncgggccggcgaatgttccttatacttgaagcccgggttgccacgggattagacgcctttgggagattgcacgcatatggggcaaaggaagggcnaccttggccgcctcgggcntttngacacggaaggnaaaattgccacattccacttgaatttgcgccagaatangggcncccacttncgtgagcgaccactttgggccccccacgggganggnacgccgtttatcatcaaagagggaaaaggcngaaaaaaaaaagcgttntatcagtagaggggacaggggaattattaggggggattaccccccccagttacaattttaccatatttgaggaggagnccgcccanagtattaaacataggacgtgttncaaacggggacnttacaccagcattancaatttccgcaatttattatagtatggggattcncagaacaaangtgggccttttgtcgaaaaatttaggaataggtccccacgg

SEQ ID NO: 46 - DNA, 733 bp, Homo sapiens
  modified_base (1)...(733): n = g, a, c or t
acagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctntccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgccaaggtgaagccgcgggagcccaaggcggaaccgcatcatcctgaacctgaaggtgatcggaacaagggcgctggcacggcagggggcgccgggcaagggggccggggacgctggcccgcccaaaaaaaggntcncccatcngcggggaaacccggcggtgtaataggggcaaagaggcaagaacaggtaccaggcaaaggaagccgggtcacatggcaggtncgcggncanagaaaccccagcaacacttgggaggccacaccgggtngcncaaccggacctttngggggggcctcacatcaccnatggtaccaagggtcgtcaccaatcgagcacggacaagaaagggggcgaaattc

SEQ ID NO: 47 - DNA, 776 bp, Homo sapiens
  modified_base (1)...(776): n = g, a, c or t
acagcacttgggagcccgaggagaacatcctggactcgcggctcattgcagccttcgaacaaaaggagagggagcgtgagctgtatgggcccaagaagaggggacccaaacccaaaactttcctcctgaaggcgtgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcaagccccggaactgngcccgcccaatttcgcccttctcggagaccggtgcgcatcatcaaccgcaagtgaagccgcgggagccaagcggaaccgatcatcctgaaacctgaaggtgatcggacaagggcgctggcggacgggggcgccgggcaggggggccgggggcgcctgggccccggccccccaaaanagtcccccaccatcagggcgagggaaaaccccgggagganaaagtagcgggcaaaangaagccaanaggaaangttcaacaaggagagaagaacgngacgaccanggcgagatcccggggaagagaaacgcncnaaggcaaaacaagattgggagaagcnacaacnggtgagcacaacagccggggccactaggcggcgggnacctaccctcccctattggaacgcagcnncgggcancaattgccgagaaagaaaggggggcgaattctncga

SEQ ID NO: 48 - DNA, 389 bp, Homo sapiens
  modified_base (1)...(389): n = g, a, c or t
acgcaggacgctctcgctgaacttcttgctcttgcctataacgcggttccgcgaggggactttggggcgggccagcgccccggcccccttgcccggcgcccccgccggccagcgcccttgtcgatcaccgttcaggttcaggatgatgcggttccggctttgggcatcccggggggcttcacctttgcngggttgactgatgcgcaccggacatctgagaaagggcgaaatgggacgggacgcagatccggggcntgccccccccttgccggggggacttcccaggggcacgggggangacaaggggggaacggggacgggtgaaccaattaccggnggtgggccagccgggcggggaatgggtcccttcttggaagaccgggtgccaa

SEQ ID NO: 49 - DNA, 313 bp, Homo sapiens
  modified_base (1)...(313): n = g, a, c or t
acgcaggacgctctcgctgaacttcttgctcttgcttataacgcggttccgcgaggggactttggggcgggccagcgcccggcccccttgccctggagcccccgccgccagcaggcccattgtcagaattcaacctttcaaggntncaagggatgaattgcgnggtcccggctntatggggattccncagaagggacttttcaaccttttgccagggatatggaacgtggnatttgccggccaaaccccggggtnactccccagaaaggaaaaaggggggcgggaaaaaatttgggcgctgggggccgacggc

SEQ ID NO: 50 - DNA, 258 bp, Homo sapiens
  modified_base (1)...(258): n = g, a, c or t
acgcaggacgctctcgctgaacttcttgctcttgccttataacgcggttccgcgaggggactttggggcgggccagcgcccgggcccccttgccccgggcccccgcccgccnagcggccctttgtcggatcaaccttcaggtcaggatgatgcggttccgctttgggcttcccggcgggtttcaccttgcgggttgatgatgcggcaacccgggtccttcccagaagaacagggggcggacaattggngcgcaggggc

SEQ ID NO: 51 - DNA, 360 bp, Homo sapiens
  modified_base (1)...(360): n = g, a, c or t
acgcaggacgctctcgctgaacttcttgctcttgcctataacgcggttccgcgaggggactttggggcgggccagcgccccggcccccctgcccgggcccccgccgccagcgcccttgtcgatcaccttcaggtncaggatgatgcggttccgcttgggctcccgcggcttcaccttgcggttgatgatgcgcaccgtctccgagaagggcgaaatgggcgggcgcagtccggggctgcccccccttgcgggatccgggcggggcaggggaccggcgggcaccatacggtggcagcggcgggaatgtccttcttgaagccggtgcacggcttgcgcttgaagttgcagcttgggccaagg

SEQ ID NO: 52 - DNA, 365 bp, Homo sapiens
acagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcagagacggtgcgcatcatc

SEQ ID NO: 53 - DNA, 539 bp, Homo sapiens
gacgcaggacgctctcgctgaacttcttggctcttgcctataacgcggttccgcgaggggactttggggcgggccagcgccccggccccctgcccgggcccccgcgcggccctttataccttcagttcagatgatgcggttccgcttgggctcccgcggcttcaccttgcggttgatgatgcgcaccgtctccgagaagggcgaaatgggcgggcgcagtccggggctgcccccctgcgggtccgggcggggcaggggacggcgggacatacggtggcagcggcggatgtccttcttgagccggtgcacggctgcgctggagtgcagcttgggcgaggaggcactggcgctcggcttgacagagaaatgcacatcactgatgcggagggcctcggcctgggcccgcgccttcaggaggaaagttttgggtttgggtcccctcttcttgggcccatacagctcacgctccctctccttttgttcgaaggctgcaatgagccgcgagtccaggatgttctcctcgggctcccaagtgctgt

SEQ ID NO: 54 - DNA, 644 bp, Homo sapiens
  modified_base (1)...(644): n = g, a, c or t
acagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggaggcgccgggcagggggccgggncgctggcccgcccccaaagtcccctcgcggaaacccgcggtaaataggcaaagaagcaaggaaggtcaggcgagaggcggtccctgcgtccgnagaaacccagcacacctggacggccaccgatgccacnggcctgggggactcctcctggtacacggtcggcacatgccgg

SEQ ID NO: 55 - DNA, 424 bp, Homo sapiens
  modified_base (1)...(424): n = g, a, c or t
acagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccattatcagcccttctcggagacggtgcgcatcatcaaccgcaaggtgaagccgcgggagcccaagcggaancgcatcatccatgaacctgaa

SEQ ID NO: 56 - DNA, 506 bp, Homo sapiens
acgcaggacgctctcgctgaacttcttgctcttgcctataacgcggttccgcgaggggactttggggcgggccagcgccccggccccctgcccggcgcccccgccgccgcgcccttgtcgatcaccttcaggttcaggatgatgcggttccgcttgggctcccgcggcttcaccttgcggttgatgatgcgcaccgtctccgagaagggcgaaatgggcgggcgcagtccggggctgcccccctgcgggtccgggcggggcaggggacggcgggacatacggtggcagcggcggatgtccttcttgagccggtgcacggctgcgctggagtgcagcttgggcgaggaggcactggcgctcggcttgacagagaaatgcacatcactgatgcggagggcctcggcctgggcccgcgccttcaggaggaaagttttgggtttgggtcccctcttcttgggcccatacagctcacgctccctctccttttgttcgaaggctgcaatgag

SEQ ID NO: 57 - DNA, 6014 bp, Homo sapiens
attatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctccgggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccgggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctga

SEQ ID NO: 58 - protein, 412 aa, Homo sapiens
MELSAVGERVFAAESIIKRRIRKGRIEYLVKWKGWAIKYSTWEPEENILDSRLIAAFEQKERERELYGPKKRGPKPKTFLLKARAQAEALRISDVHFSVKPSASASSPKLHSSAAVHRLKKDIRRCHRMSRRPLPRPDPQGGSPGLRPPISPFSETVRIINRKVKPREPKRNRIILNLKVIDKGAGGGGAGQGAGALARPKVPSRNRVIGKSKKFSESVLRTQIRHMKFGAFALYKPPPAPLVAPSPGKAEASAPGPGLLLAAPAAPYDARSSGSSGCPSPTPQSSDPDDTPPKLLPETVSPSAPSWREPEVLDLSLPPESAATSKRAPPEVTAAAGPAPPTAPEPAGASSEPEAGDWRPEMSPCSNVVVTDVTSNLLTVTIKEFCNPEDFEKVAAGVAGAAGGGGSIGASK

SEQ ID NO: 59 - DNA, 108 bp, Homo sapiens
actttctcggcctatccggaatgccccgacgttactcggactaccccgatgcatacaccacatgaaacatcctatcatctgtaggctcattcatttctctaacagcag

SEQ ID NO: 60 - DNA, 108 bp, Homo sapiens
ctgctgttagagaaatgaatgagcctacagatgataggatgtttcatgtggtgtatgcatcggggtagtccgagtaacgtcggggcattccggataggccgagaaagt

SEQ ID NO: 61 - DNA, 110 bp, Homo sapiens
  modified_base (1)...(110): n = g, a, c or t
actttctcggctatccggaatgccccgacgttactcggactaacccgatgcatacaccacatgaaacatcctatnatactgtaggctccattcatttctctnacagcaga

SEQ ID NO: 62 - DNA, 110 bp, Homo sapiens
ctgctgttagaagaaatgaatgagccttacagatgataggatgtttcatgtggtgtatgcatcggggtagtccgagtaacgtcggggcattccggataggccgagaaagt

SEQ ID NO: 63 - DNA, 1570 bp, Homo sapiens
agccattttacctcacccccactgatgttcgccgaccgttgactattctctacaaaccacaaagacattggaacactatacctattattcggcgcatgagctggagtcctaggcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaa

SEQ ID NO: 64 - protein, 513 aa, Homo sapiens
MFADRWLFSTNHKDIGTLYLLFGAWAGVLGTALSLLIRAELGQPGNLLGNDHIYNVIVTAHAFVMIFFMVMPIMIGGFGNWLVPLMIGAPDMAFPRMNNMSFWLLPPSLLLLLASAMVEAGAGTGWTVYPPLAGNYSHPGASVDLTIFSLHLAGVSSILGAINFITTIINMKPPAMTQYQTPLFVWSVLITAVLLLLSLPVLAAGITMLLTDRNLNTTFFDPAGGGDPILYQHLFWFFGHPEVYILILPGFGMISHIVTYYSGKKEPFGYMGMVWAMMSIGFLGFIVWAHHMFTVGMDVDTRAYFTSATMIIAIPTGVKVFSWLATLHGSNMKWSAAVLWALGFIFLFTVGGLTGIVLANSSLDIVLHDTYYVVAHFHYVLSMGAVFAIMGGFIHWFPLFSGYTLDQTYAKIHFTIMFIGVNLTFFPQHFLGLSGMPRRYSDYPDAYTTWNILSSVGSFISLTAVMLMIFMIWEAFASKRKVLMVEEPSMNLEWLYGCPPPYHTFEEPVYMKS

SEQ ID NO: 65 - DNA, 425 bp, Homo sapiens
  modified_base (1)...(425): n = g, a, c or t
ggcctgaactgnactgagcagcaccgcacanaggaggaagggcaaaaaggacgtcccaaagacccaaagggtgagccagnctgnaccatccagcagcaagatgtgcagacaggtacagnaggaagaanacatggttggccttcatgagccccatccgctccactgtggnccgcanactcccggaactcatctgtcagctctttattcttggtgggntcaaagctgggctgntctggagacagttctccaatcaggagagagttcatatacttcttcacaaggcccttgtggatgtggaaggccacaaagggatccgtggnatcctgnccggngtagtggctgatganccgggagccccctgnatgccggcggagtgaactcgctgatgttgtacaccttacggtcgatcactanccaccgctcct

SEQ ID NO: 66 - DNA, 442 bp, Homo sapiens
  modified_base (1)...(442): n = g, a, c or t
cagacgctcaaggatgcgaggagcggtggctagtgatcgaccgntaaggtgtacaacatcagcgagttcacccgccggcatccagggggctcccgggtcatcagccactacgccgggnaggatgccacggatccctttgtggccttccacatcaacaagggccttgctgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcc

SEQ ID NO: 67 - DNA, 1335 bp, Homo sapiens
atggcccccgacccgttggccgccgagaccgcggctcagggacttaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttggacacctgtcggtcttcagcacctcaaagtggaaccatctgctacaccattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaattatatgccgtacaaccaccagcacaaatacttcttcctaattgggcccccggccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataa

SEQ ID NO: 68 - DNA, 4213 bp, Homo sapiens
tccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaaaaaaaaaaaaaag

SEQ ID NO: 69 - protein, 444 aa, Homo sapiens
MAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 70 - DNA, 1044 bp, Homo sapiens
caaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctttaaaaaaaaaaaaaa

SEQ ID NO: 71 - protein, 190 aa, Homo sapiens
MAEKTQKSVKIAPGAVVCVESEIRGDVTIGPRTVIHPKARIIAEAGPIVIGEGNLIEEQALIINAYPDNITPDTEDPEPKPMIIGTNNVFEVGCYSQAMKMGDNNVIESKAYVGRNVILTSGCIIGACCNLNTFEVIPENTVIYGADCLRRVQTERPQPQTLQLDFLMKILPNYHHLKKTMKGSSTPVKN

SEQ ID NO: 72 - DNA, 288 bp, Homo sapiens
  modified_base (1)...(288): n = g, a, c or t
actgtncctgcttggccgagtggagactggtgttctcaaacccggatatggtggtcacctttgctccagctcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgtngctggtgacagcaaaaatgacccaccaatggaagcagctggcttcactgctcaggtgattatcctgaaccatccaggccaaataagcgcc

SEQ ID NO: 73 - DNA, 285 bp, Homo sapiens
ggcgcttatttggcctggatggttcaggataatcacctgagcagtgaagccagctgcttccattggtgggtcatttttgctgtcaccagcaacgttgccacgacgaacatccttgacagacacattcttgacattgaagcccacattgtccccaggaagagcttcactcaaagcttcatggtgcatttcgacagattttacttccgttgtaacgttgactggagcaaaggtgaccaccataccgggtttgagaacaccagtctccactcggccaacaggaacagt

SEQ ID NO: 74 - DNA, 285 bp, Homo sapiens
actgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgcc

SEQ ID NO: 75 - DNA, 285 bp, Homo sapiens
  modified_base (1)...(285): n = g, a, c or t
ggcgcttatttggnctggatggttcaggataatcacctgagcagtgaagccagctgcttccattggtgggtcatttntgntgtcaccagcaacgttgccacgacgaacatccttgacagacacattcttgacattgaagcccacattgtccccaggaagagcttcactcaaagcttcatggtgcatttcgacagattttacttccgttgtaacgttgactggagcaaaggtgaccaccataccgggtttgagaacaccagtctccactcggccaacaggaacagt

SEQ ID NO: 76 - DNA, 1833 bp, Homo sapiens
ggcacgagggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 77 - protein, 462 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 78 - DNA, 106 bp, Homo sapiens
gtccaactcaaagatatgggagaggatttggagtgcctctgtcagataatgaggacagtgggacctagattagaccatgaacgagccaagtccttaatggatcagt

SEQ ID NO: 79 - DNA, 107 bp, Homo sapiens
actgatccattaaggacttggctcgttcatggtctaatctaggtcccactggtcctcattatctgacagaggcactccaaatcctctcccatatctttgagttggac

SEQ ID NO: 80 - DNA, 110 bp, Homo sapiens
  modified_base (1)...(110): n = g, a, c or t
actgatccattaaggacttggntcgttcatggtctaatctanagtcccactggtcctcattatctgacaggagagcactccaaatcctctcccatatctttgagttggac

SEQ ID NO: 81 - DNA, 3820 bp, Homo sapiens
cagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgaaaaaaaaaaaaaaaaaaaaaaaaaaaaa

SEQ ID NO: 82 - protein, 907 aa, Homo sapiens
MESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 83 - DNA, 86 bp, Homo sapiens
acatccaggacacggtgatggcacgcacaccattacctacattcccctctgccccggggcctacaccgtcaccatcaagtacggca

SEQ ID NO: 84 - DNA, 213 bp, Homo sapiens
  modified_base (1)...(213): n = g, a, c or t
tgccgtacttgatggtgacggtgtaggccccggggcagaggggaatgtaggtaatggtgtgcgtgccatcaccgtggtcctggatgttcgcagaaaccagcacactggagccaccgctgcaccgggcttgggggctcctccttgtacagctcgtccatgccgagagaagggcgaattcttgcagatatncatcacactggcgggcgctcgagc

SEQ ID NO: 85 - DNA, 305 bp, Homo sapiens
  modified_base (1)...(305): n = g, a, c or t
acatcaggaccacggatgatggcacgcacaccatacctacatcccctctgccccggggcctacaccgtcaccatcaagtacggcaccgnagaacccagcacagtggtnagatagataaagcggccgctcgactagtctgaggtctgaatactcaactgaactgtacgtaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 86 - DNA, 8368 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcgccccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtcaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggtacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatgggggcacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagctgcccctgccctgtgccgtgctgcgctcacctgcctccccagccagccgctgacctctcggctttcacttgggcagagggagccatttggtggcgctgcttgtcttctttggttctgggaggggtgagggatgggg

SEQ ID NO: 87 - protein, 2647 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGHEHIPGSPYRVVVP

SEQ ID NO: 88 - DNA, 100 bp, Homo sapiens
  modified_base (1)...(100): n = g, a, c or t
ccgcgagggcagcggcggcggcaagatggcggacttcctgccgtcgcggtccgtgctgtccgtgtgcttccccgggnctgcctgctgacgagtggcgagg

SEQ ID NO: 89 - DNA, 1402 bp, Homo sapiens
tggggccggagaggcggcgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatgcttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccc

SEQ ID NO: 90 - protein, 377 aa, Homo sapiens
MADFLPSRSVLSVCFPGCLLTSGEAEQQRKSKEIDKCLSREKTYVKRLVKILLLGAGESGKSTFLKQMRIIHGQDFDQRAREEFRPTIYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMLDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 91 - DNA, 746 bp, Homo sapiens
  modified_base (1)...(746): n = g, a, c or t
tttgccctgacccgggccattgccagaagacgtcttctcggggcgccaggattcacctttccttcccgacctcaacttcttcgcggccgactcctgtctccagctatccggaggcctctcccctagcctacagggttctctcgacagccctggtccctttttccgatggacaaagagcttggattttttcaccaagtaccgctctgtgcccaattcggagcctgcnaggttttacccccccctttaaaaaagccccctttggttatataccccttacccttaccccccgtgggttaccccttntatacggaaacccccccctggtcggccttcccctttatggggccccggtcttaaaccttggggaaacacaanaacttccggaaagggacccccatttcgatttaccccgcaaaagccccccncttttcccaaangggataccggccaagttntaaaggaaacccttttaanatttggattgaggattatttattataggggccctattaaaacaaacaacaacacttctttttatccacaaagtgggngggatntaaatgatttatcaaancccgtttgtggtaacaaaacaatttttttacaaaacgncccgggagtatattagttataaaaaaaatattcctccccgaaaaacattattctccccccccccttatatattttaacaccccatatattcaacngctatttattattgccaccatatttttaccccataaata

SEQ ID NO: 92 - DNA, 305 bp, Homo sapiens
tttgccctgacccgggccattgccagaagacgtcttctcggggcgccaggattcacctttccttcccgacctcaacttcttcgcggccgactcctgtctccagctatccggaggcctctcccccttagcctacagggttctctcgacagcccggtcccggttttttatttccccggaagggggaagggaaggctggggattgtgtttcgacgcagtacgctctgtgccatcgacctgcagtttccctaacctgtttcctcctcccggtcctttcgacccccgcgctccttggccgtctactggaa

SEQ ID NO: 93 - DNA, 709 bp, Homo sapiens
  modified_base (1)...(709): n = g, a, c or t
aaaangtatagactcactatagtggcgaattgggnccatctagatgcatgctcgagcggccgccaggtgtgatggatatctgcagaattgctgccgcttacgacagtcagtgagtatcagacctcagagctagatcgagcggccgctttatctatctaaccactgtgctgggttcgtgcggnccccgctagagtttaatgtattcctgagatttcactggacaggagtctaccaaacggaatttttctgtgtgaattttaaaagataaccgagtgcccaatattttagaacgaagaagaaagggagtggattaaacgctaagttcagtaataccntgaagtttttagcaaaagcgacataagttctatggcgactgaggggtgggagaggctcgacgnntttnaccaagtagacgggccaaggaaggcgcggnggggtccggaaacangggacccggggcagggggaggggaaaaaccagggttacagcgngaaaaacctggccaagggactacccggaacgtatgagggccaaacaaaagaaaggccggattaaccctatgggggattggaaaaaaaaaatccccaaagggcttcctatatccccctccgggggaaaaaaacacagggggggaaacccccgggaggccctatggatccaggacacgaaagcgaaaacccccctgggtaagagagccctaaggggggga

SEQ ID NO: 94 - DNA, 667 bp, Homo sapiens
  modified_base (1)...(667): n = g, a, c or t
cccccctagagtttaattattcctgagatttcactggaaggagtctaccaaacggaatttttctgtgtgaattttaaaagataaccgagtgcccaatattttagaagaagaagaaagggagtggattaaacgctaattcagtaatacctgaattttagcaaaacacataagtctatgcgactgagggtgggagaggctcgatttttccagtagacggccaaggagcgcgggggtcgaaaggaccgggaggaggaaacaggttagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagttgaggtcgggaaggaaaggtgaatcctggcgccccgagaagacgtcttctggcaatggcccgggctccagcccgacggccccgcgcagcgcgcaagccgggacttcgaacgcacncntgcagccctcataagcgaacggcataaaaggcccggggggtccagcgcattaagggccccccggaccatcctccgggcgaggtgaacaagcggggttacccaaggccggcggagaggtcccgaggccattngactagggnt

SEQ ID NO: 95 - DNA, 438 bp, Homo sapiens
tttgccctgacccgggccggggctgtagactagagagggagagaagaaaacccaaaagcaatggcctgggactgccggaggctggtggcggcggggcgcgcaggctgcgcacgggtttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaaccctgcggccagcccgggcggcccctccgcctcgcgggcggcgtgggaagcctgctgtcacccgccggaggtggttgccgggggccc

SEQ ID NO: 96 - DNA, 474 bp, Homo sapiens
cccccctagagtttaattattcctgagatttcactggaaggagtctaccaaacggaatttttctgtgtgaattttaaaagataaccgagtgcccaatattttagaagaagaagaaagggagtggattaaacgctaattcagtaatacctgaattttagcaaaacacataagtctatgcgactgagggtgggagaggctcgatttttccagtagacggccaaggagcgtgggggtcgaaaggaccgggaggaggaaacaggttagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagttgaggtcgggaaggaaaggtaattccttctccagttccagcagctgcgtgttggtgtaagccgtg

SEQ ID NO: 97 - DNA, 397 bp, Homo sapiens
tttgccctgacccgggccggggctgtagactagagagggagagaagaaaacccaaaagcaatggcctgggactgccggaggctggtggcggcggggcgcgcaggctgcgcacggttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagccttgccttgcccgggagcccttggaggacatctgcgaccctgccgaggaacccgcgggccagcccgggcggccccttccgcctcgcgggcgggcg

SEQ ID NO: 98 - DNA, 447 bp, Homo sapiens
  modified_base (1)...(447): n = g, a, c or t
cccccctagagattctaatgtacttcctgagattatcactggaaggagatctaccaaacggaatttcttccgtgtgaattttaacagagataaccgagtgcccatattttagaagaagaagaaagggagtggattaaacgctaattcagtaatacctgaattttagcaaagacacataagtctatgcgactgagggtgggagaggctcgatttttccagtagacggccaaggagcgcgggggtcgaaaggaccgggaggaggaaacaggttagggaaactgcaggtcgactggcacagagcgtactggtgaaaaaatccagctcttcctcggaaaaagggaccgggctgtcgagagaaccctggtaggctaggggagaggcctccggatagctggagacaggagtcggccgcgaangaagttgaggtcgggaaggaaaggtgaatcc

SEQ ID NO: 99 - DNA, 558 bp, Homo sapiens
  modified_base (1)...(558): n = g, a, c or t
aaattggaaatagactcactatagggcgaattgggccctctagaatgacatgctcgagcggccagnccaaggtgtgatggatatctgcagaattctgcccttacgacagtcagtgagtatcagacctcagagctagatcgtagcggccgctttatctatctaaccactgtgctgggtntctgcggcccccgctagagtttaattattcctgagatttcactggccagggagtctaccaacagggaatttttctgtgtgaattttaaaagataaccgagtgcccaatattttagaagaagaagaaagggagtggattaaacgctaattcagtaatacctgaattttagcaaaacacataagtctatgcgactgagggtgggagaggctcgatttttccagtagacggccaaggagcgcgggggncgaaaggaccgggaggaggaaacaggttagggaaactgcaggtcgatggcacagagcgtactggtgaaaaaatccagctcttcctcggaaaaagggaccggggtgtaagagagaaccctggnaaggccagcggga

SEQ ID NO: 100 - DNA, 436 bp, Homo sapiens
  modified_base (1)...(436): n = g, a, c or t
cccccctagagtttaattattcctgagatttcactggaaggagtctaccagacggaatttttctgtgtgaattttaagaagataaccgagtgcccaatattttagaagaagaagaaagggagtggattaaacgctaattcagtaatacctgaattttagcaaaacacataacgtctatgcgactgagggtgggagaggctcgattttgtccagtacgacggccaaggagcgcgcggggtcgaaaggaccgggaggaggaaacaggttagggaaactgcaggtcgatggcacagagcgtactggtgaaaaaatccagctctacctcggaaaaagggaccgggaccngatcgagagaaccctgtaggctaggggagaggccatccggatagactggagacaggagtcggaacgcgaagaagtacgaggtcgnggaagg

SEQ ID NO: 101 - DNA, 642 bp, Homo sapiens
  modified_base (1)...(642): n = g, a, c or t
cccccctagagtttaattattcctgagatttcactggaaggagtctaccaaacggaatttttctgtgtgaattttaaaagataaccgagtgcccaatattttagaagaagaagaaagggagtggattaaacgctaattcagtaatacctgaattttagcaaaacacataagtctatgcgactgagggtgggaggggctcgatttttccagtagacggccaaggagcgcgggggtcgaaaggaccgggaggaggaaacaggtnagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagtngaggtcgggaaggaaagcgtgaaagtccctggcacagccaccgaaggcaaagaacggatcntttcatnggacaaaaatgggacccaggagcatcccaagcacccggancggggcgccccggacgcangcagnagcgcaaagacagggngaactcacgaaaggcagnacntgacgaccccattccaaaaaggagagaacaangggnataaaaagggaccaggagaagancaag

SEQ ID NO: 102 - DNA, 417 bp, Homo sapiens
cccccctagagtttaattattcctgagatttcactggaaggagtctaccaaacggaatttttctgtgtgaattttaaaagataaccgagtgcccaatattttagaagaagaagaaagggagtggattaaacgctaattcagtaatacctgaattttagcaaaacacataagtctatgcgactgagggtgggagaggctcgatttttccagtagacggccaaggagcgcgggggtcgaaaggaccgggaggaggaaacaggttagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagttcgaggtc

SEQ ID NO: 103 - DNA, 452 bp, Homo sapiens
cccccctagagtttaattattcctgagatttcactggaaggagtctaccaaacggaatttttctgtgtgaattttaaaagataaccgagtgcccaatattttagaagaggaagaaagggagtggattaaacgctaattcagtaatacctgaattttagcaaaacacgtaagtctatgcgactgagggtgggagaggctcgatttttccagtagacggccaaggagcgcgggggtcgaaaggaccgggaggaggaaacaggttagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagttgaggtcgggaaggaaaggtgaatcctggcgccccgagaagac

SEQ ID NO: 104 - DNA, 462 bp, Homo sapiens
  modified_base (1)...(462): n = g, a, c or t
cccccctagagtttaattattcctgagatttcactggaaggagtctaccaaacggaatttttctgtgtgaattttaaaagataaccgagtgcccaatattttagaagaagaagaaagggagtggattaaacgctaattcagtaatacctgaattttagcaaaacacataagtctatgcgactgagggtgggagaggctcgatttntccagtagacggccaaggagcgcgggggtcgaaaggaccgggaggaggaaacaggtagggaaactgcaggtcgatggcacagagcgtactggtgaaaaaatccagctcttcctcggaaaaagggaccgggactgtcgagagaaccctgnaggctaggggagaggcctccggatagctggagacaggagtcggaccgcgaagcaagtctgaggtcgggaaggaaaggtgaatcctggcgccccgagaagacgtcttct

SEQ ID NO: 105 - DNA, 404 bp, Homo sapiens
  modified_base (1)...(404): n = g, a, c or t
cccccctagagtttaattattcctgagatttcactggaaggagtctaccaaacggaatttttctgtgtgaattttaaaagataaccgagtgcccaatattttagaagaagaagaaagggagtggattaaacgctaattcagtaatacctgaattttagcaaaacacataagtctatgcgactgagggtgggagaggctcgatttttccagtagacggccaaggagcgcgggggtcgaaaggaccgggaggaggaaacaggttagggaaactgcaggtcganggcacagagcgtactggtgaaaaaatccagctcttcctcggaaaaagggaccgggcatgtcgagagaaccctgganggctaggggagaggcctaccggatagcnggagacaaggagncggacg

SEQ ID NO: 106 - DNA, 526 bp, Homo sapiens
  modified_base (1)...(526): n = g, a, c or t
tttgccctgacccgggccggggctgtagactagagagggagagaagaaaacccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccactccctttcttcttcttctaaaatattgggcactcggttatcttttanaaatttcacacagaaaattccgtttggtagactccttccagtgaaatctcaggaattattaactctaggggggccgcaaga

SEQ ID NO: 107 - DNA, 563 bp, Homo sapiens
  modified_base (1)...(563): n = g, a, c or t
cccccctagagtttaattattcctgagatttcactggaaggagtctaccaaacggaatttttctgtgtgaattttaaaagataaccgagtgcccaatattttagaagaagaagaaagggagtggattaaacgctaattcagtaatacctgaattttagcaaaacacataagtctatgcgactgagggtgggagaggctcgatttttccagtagacggccaaggagcgcgggggtcgaaaggaccgggaggaggaaacaggttagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagttgaggtcgggaaggaaaggtgaatcctggcgccccgagaagacgtcttctggcaatgggttttcttctctccctctctagtctacagccccggcccgggtcagggcaaaccggagaacccagcacactggagccaccgngtgccaccggcttgg

SEQ ID NO: 108 - DNA, 475 bp, Homo sapiens
tttgccctgacccgggccggggctgtagactagagagggagagaagaaaacccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgaccgtgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccactccctttcttcttcttctaaaatattgggcacatcggttatctttttaaaattcacacagaaaaattccgttaggg

SEQ ID NO: 109 - DNA, 545 bp, Homo sapiens
cccccctagagtttaattattcctgagatttcactggaaggagtctaccaaacggaatttttctgtgtgaattttaaaagataaccgagtgcccaatattttagaagaagaagaaagggagtggattaaacgctaattcagtaatacctgaattttagcaaaacacataagtctatgcgactgagggtgggagaggctcgatttttccagtagacggccaaggagcgcgggggtcgaaaggaccgggaggaggaaacaggttagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagttgaggtcgggaaggaaaggtgaatcctggcgccccgagaagacgtcttctggcaatgggttttcttctctccctctctagtctacagcccgtggccggggtcagggcaaaccggagaaaccagcacactggagcca

SEQ ID NO: 110 - DNA, 485 bp, Homo sapiens
cccccctagagtttaattattcctgagatttcactggaaggagtctaccaaacggaatttttctgtgtgaattttaaaagataaccgagtgcccaatattttagaagaagaagaaagggagtggattaaacgctaattcagtaatacctgaattttagcaaaacacataagtctatgcgactgagggtgggagaggctcgatttttccagtagacggccaaggagcgcgggggtcgaaaggaccgggaggaggaaacaggttagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagttgaggtcgggaaggaaaggtgaatcctgggcgccccgagaagacgtcttctaggcaatggcccgggtcagggcaaa

SEQ ID NO: 111 - DNA, 467 bp, Homo sapiens
tttgccctgacccgggccggggctgtagactagagagggagagaaggaaacccaaaagcaatggcctgggactgccggaggctggtggcggcggggcgcgcaggctgcgcacggtttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggccccttccgcctcgcgggcggcgtgggaagcctgctgtcacccgccggaggtggtgccgggggccttaagcgcggaccccggcctttagccgttcgc

SEQ ID NO: 112 - DNA, 390 bp, Homo sapiens
  modified_base (1)...(390): n = g, a, c or t
tttgccctgacccgggccggggctgtagactagagagggagagaagaaaacccaaaagcaatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagccatgcctgcccgggagcccttggaggacatctgcgacccttgccgaggaacccgcgggccagcccggnngcggccccatccgcctcg

SEQ ID NO: 113 - DNA, 723 bp, Homo sapiens
tttgcctgacccgggccggggctgtagactagagagggagagaagaaaacccaaaagcaatggcctgggactgccggaggctggtggcggcggggcgcgcaggctgcgcacggcttacaccaacacgcaattctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccgaggcctctcccctagcctacaggggttctctcgacagcccggtccctttttccgaggaagagctggattttttcaccagtacgctctgtgccatcgac

SEQ ID NO: 114 - DNA, 552 bp, Homo sapiens
tttgccctgacccgggccggggctgtagactagagagggagagaagaaaacccaaaagcaatggcctgggactgccggaggctggtggcggcggggcgcgcaggctgcgcacggcttacaccaacacgcagctctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtctt

SEQ ID NO: 115 - DNA, 375 bp, Homo sapiens
tttgccctgacccgggccggggctgtagactagagagggagagaagaaaacccaaaagcaatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccccttgccgaggaacccgcggccagcccgggcggccc

SEQ ID NO: 116 - DNA, 562 bp, Homo sapiens
tttgccctgacccgggccggggctgtagactagagagggagagaagaaaacccaaaagcaatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcg

SEQ ID NO: 117 - DNA, 666 bp, Homo sapiens
  modified_base (1)...(666): n = g, a, c or t
tttgccctgacccgggccggggctgtagactagagagggagagaagaaaacccagaagcaatggcctgggactgccggaggccttggttggcggcggggcgcgcaggcttgcggccaacggttttacaccaaacacgcagctgcttggaactggagaaaggaaattaaccctttttcctttcccgaaccttcaaactttctttcggcgggccggacttccttgtctccagcttatccggagagcgccttctccccattagccctaacaaggggttctctcnggacaggcccgcggggtccccttttttccggagaaagagcttgaatttttccaaccaaggtacggcccattcgtttggttgcccccaatttcgtagaaccctttgcacaaggttttttccccctataaaaaccctgtggtttttccccttccacctttccccgcgggggtatcccttttttcaggaagccgcgccnacaaaagggccttcctattttgggcccggtgtactctttagcgtgtgggaaaacagaattcgtcgggaaggccctttcttccacaaaccccccattcnagaggtccggggcaagatttagaaactttattggactatgatttgtgttgagggcccttaaacacaaaattttcaagggggattattttta

SEQ ID NO: 118 - DNA, 743 bp, Homo sapiens
  modified_base (1)...(743): n = g, a, c or t
tttgccctgacccgggccggggctgtagactagagagggagagaagaaaacccaaaagcaatggcctgggcactgcctggcgctttgggaagcgtgctgtcacccgtccggagggtggatgccgtggggtcctatgaagctgcggacccccggtctttagaccgtacgcttagagcggcggacaggcncgtcgaggtcccggctgcgaacagcgcggagcccgggcngcatgaagcctcgtgtcncaatttnccaagaatggaagggttcttacccttcngaggcgcggcccaaggngtacttcttaccccctgtgtttcccttttccccgaaaccctctcgaagtctttcctttacgggcgnggccaganactccgttgttcctaccctanggattacancctgagaagaccttttcncacgcctcnttgaggcctcactgtaaacnggtgggagggttngtctccgttcttncggggacctaagcggccccgctgggcgaaccgcggttttttttaaccctcaccgggagaaagnagacaaaangacaaagggtcttttgaggaagattccatctttncacnacccgtatagattagttaacgggtctcccttgtgcttcgcccacatatttaagtaccggctgtgggcgaagcgttcttggcccnccaattacacagtccnctttgtgatataacccnctttccactcttacccgngcgggggactcccacttttttttc

SEQ ID NO: 119 - DNA, 544 bp, Homo sapiens
  modified_base (1)...(544): n = g, a, c or t
tttgccctgacccgggccggggctgtagactagagagggagagaagaaaacccaaaagcaatggcctgggactgccggaggctggtggcggcggggcgcgcaggctgcgcnacggttacactcaactacgcagctgctggaacttggagaaggaatttccactttaataagtaccttgtgtccgggccacagccggcggtcagagatcngcgggcctttgcctggacccttcagcccgaaaagggcaaggtcnaagaggctcatagggtgtccagagacncggnggcggccaattgaagaggcaacgagaggccggccaaggaacggcagcaacccggaagaaggcccggccgcnggcattgggggggaagccttngcccttggccccggtggtgaaggtccgctttgggaangggagcatattcctngcggaaacgccttgtcncagaagggtagaaaccccgtgacggggccaagggcgcccgggggccggcggccccccctttccggacccatttccgggccggggngccgggngcagttg

SEQ ID NO: 120 - DNA, 1520 bp, Homo sapiens
gaattccgggggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccacttcctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtac

SEQ ID NO: 121 - protein, 356 aa, Homo sapiens
MNFEFEREIGFINSQPSLAECLTSFPAVLETFQTSSIKESTLIPPPPPFEQTFPSLQPGASTLQRPRSQKRAEDGPALPPPPPPPLPAAPPAPEFPWMKEKKSAKKPSQSATSPSPAASAVPASGVGSPADGLGLPEAGGGGARRLRTAYTNTQLLELEKEFHFNKYLCRPRRVEIAALLDLTERQVKVWFQNRRMKHKRQTQHREPPDGEPACPGALEDICDPAEEPAASPGGPSASRAAWEACCHPPEVVPGALSADPRPLAVRLEGAGASSPGCALRGAGGLEPGPLPEDVFSGRQDSPFLPDLNFFAADSCLQLSGGLSPSLQGSLDSPVPFSEEELDFFTSTLCAIDLQFP

SEQ ID NO: 122 - DNA, 174 bp, Homo sapiens
ccgatgagccgcttggcgtcaaagaccgtgttctcggggttggaggtgagctggttcttggcggcatcgccaatcagacgttccccttcaggagtgaaggcgacataggacggcgtgatgcggttgccctgatcgttggcgatgatctccacgcggccgctcgcgatctagaac

SEQ ID NO: 123 - DNA, 173 bp, Homo sapiens
gttctagatcgcgagcggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccagcggctcatcgg

SEQ ID NO: 124 - DNA, 174 bp, Homo sapiens; identical to SEQ ID NO: 122

SEQ ID NO: 125 - DNA, 176 bp, Homo sapiens
gttctagatcgcgagcggccgcgtggagatcatcgccaacgatcagtggcaaccgcatcacgccgtcctatgtcgccttcactcctgaaggggaacgtctgattggcgatgccgccaagaaccagctcacctccaaacccgagaacacggtctttgacgccaagcggctcatctgg

SEQ ID NO: 126 - DNA, 175 bp, Homo sapiens
gttctagatcgcgagcggccgcgtggagatcatcgccaacgatcaggggcaaccgcatcacgccgtcctatgtcgccttcactcctgaaggggaacgtctgattggcgatgccgccaagaaccagctcacctccaaccccgagaacacggtctttgacgccaagcggctcatcgg

SEQ ID NO: 127 - DNA, 1917 bp, Homo sapiens
atggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaactccaccaccaccaccaccac

SEQ ID NO: 128 - DNA, 3925 bp, Homo sapiens
acagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcaggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggattttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacccgggaggcagaggttgcagtgagccgagatcacaccactgtactccagcccggcactccagcctggcgacaagagtgagactccacctcaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaaaaaaaaaaaaaaaaaa

SEQ ID NO: 129 - protein, 654 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 130 - DNA, 381 bp, Homo sapiens
  modified_base (1)...(381): n = g, a, c or t
ctggctttaactctgacccaaagtagtatttgatggatcaccaacatgtatcagtaaatattacaataatgnatgtagtaatattgatgcaggcatcaatccattctgaattcttaacaccatagttctttacctctacggtaaaaacagggacctgtggcatgatctggtactcccaatatacgatagggttcatgttataggattcaattgtaacattagttggtgtaggcactgaggacggccccagatccgcggtgcccatctcagccctgctcacaccctgcatgacaaggggtaggagaaagaggagagccatgctgctaccgacggtcgctggctccaaccccgagcgcctgcgggaccagcccagcgctgccc

SEQ ID NO: 131 - DNA, 376 bp, Homo sapiens
ctggctttaactctgacccaaagagaatttgatggatcaccaacatgatcagaaatattacaataatgatgagaaatattgatgcaggcatcaatccattctgaattcttaacaccatagttctttacctctacggtaaaaacagggacctgtggcatgatctggtactcccaatatacgatagggttcatgttataggattcaattgtaacattagttggtgtaggcactgaggacggccccagatccgcggtgcccatctcagccctgctcacaccctgcatgacaaggggtaggagaaagaggagagccatgctgctaccgacggtcgctggctccaaccccgagcgcctgcgggaccagcccagcgctgccc

SEQ ID NO: 132 - DNA, 376 bp, Homo sapiens
gggcagcgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccag

SEQ ID NO: 133 - DNA, 376 bp, Homo sapiens; identical to SEQ ID NO: 132

SEQ ID NO: 134 - DNA, 376 bp, Homo sapiens; identical to SEQ ID NO: 131

SEQ ID NO: 135 - DNA, 376 bp, Homo sapiens; identical to SEQ ID NO: 132

SEQ ID NO: 136 - DNA, 376 bp, Homo sapiens; identical to SEQ ID NO: 131

SEQ ID NO: 137 - DNA, 376 bp, Homo sapiens; identical to SEQ ID NO: 131

SEQ ID NO: 138 - DNA, 376 bp, Homo sapiens; identical to SEQ ID NO: 132

SEQ ID NO: 139 - DNA, 2059 bp, Homo sapiens
ccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacatatccagtactcctggttcctaggtgagcaggtgatgccccagggacctttgtagccacttcactttttttcttttctctgccttggtatagcatatgtgttttgtaagtttatgcatacagtaattttaagtaatttcagaagaaattctcgaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 140 - protein, 489 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 141 - DNA, 630 bp, Homo sapiens
ctattgtgcttgcttcatcaccggccattatcagaatgttttttagaccatctagaaccacctgaaccacttgagaatctttcactgacagtaaattacagaacggtggtattacattctgctgtacaaggtactcaacctgatcttttctgccacttattgttaagttgctgattgcccaagcagcttctttttgtgttccaaagtcccccttagcaagctgatgaattatcataggaattaatccagcatctattacagcttgaacttgttgctggttgcctgctgttatgttggaaaggaaccacactgcttccttatttatcttctcttttgggtgtgataagagatttgggaagtgtgacaggacatcacaattgagaacaacctgggtctgctcgtcggtgccagtcactatgttgccaactgctctgagggctgctgtttgaactttgacttcctgatggctcagaaggggcacaagaaagggcacaactcctgaattccaataaccatctggtatctgttcattaccttccatctgtcaaagttatgacagagcccaaaacaagtgtcttacaagaaatgtttatatctggaatgggtaatatgaaggacaacataaaaggc

SEQ ID NO: 142 - DNA, 660 bp, Homo sapiens
  modified_base (1)...(660): n = g, a, c or t
ctattgtgcttgcttcatcaccggccattatcagaatgttttttagaccatctagaaccacctgaaccacttgagaatctttcactgacagtaaattacagaacggtggtattacattctgctgtacaaggtactcaacctgatcttttctgccacttattgttaagttgctgattgcccaagcagcttctttttgtgttccaaagtcccccttagcaagctgatgaattatcataggaattaatccagcatctattacagcttgaacttgttgctggttgcctgctgttatgttggaaaggaaccacacatgcttccttatttatcttctctttagggtgtgataagagatttgggaagtgtgacaggacatcacaatttgaggaacaacctgggtctgactcgtcggtgccagtcactatgttgccaactgcatctgagggcctgctgtttgaaactttgacttccctgatggctcagaaggggcacaagaaagggcnacaaactcctggaatcncaataaacaatctgtatctgttcaataaccctcccatcctggtgcaaaggtanctgaacacgggaggccccaaaacaggtggtcctacaaggaaatggtgaacaaacatggaaatgggaatagganggaccaccacataaagg

SEQ ID NO: 143 - DNA, 686 bp, Homo sapiens
  modified_base (1)...(686): n = g, a, c or t
ctattgtgcttgcttcatcaccggccattatcagaatgttttttagaccatctagaaccacctgaaccacttgagaatctttcactgacagtaaattacagaacggtggtattacattctgctgtacgaggtactcaacctgatcttttctgccacttattgttaagttgctgattgcccaagcagcttctttttgtgttccaaagtcccccttagcaagctgatgaattatcataggaattaatccagcatctattacagcttgaacttgttgctggttgcctgctgttatgttggaaaggaaccacactgcttccttatttatcttctcttttgggtgtgataacgagatttgggaagtgtgacaggacatcacaattgagaacaacctgggtctgctcgtcggtgccagtcactatgttgccaactgctctgagggctgctgttttgaactttgacttcctgatggctcagcaaggggcacaagaaaagggcacaaacttccctgaaaatccaataaaccaatctgtaattctggttcacatttaccttccaattcttggttcaaaggtatgacagaagccccaaaacaggtgttctaccaagaaattgttcacataatcctgaatgggaatantgacnggacacacattaaagccgcaaaaaccanacanacaaaaccagac

SEQ ID NO: 144 - DNA, 487 bp, Homo sapiens
  modified_base (1)...(487): n = g, a, c or t
ctttatgtgtcctcatataccatacagatataaacattcttgtagacactgtttgggctctgtcatacttgacagatggaggtaatgaacagatacagatggttattgattcagagattgtgccctttcttgatgccccttctttggggaaaanccccaaactcccacggggagaagcgtccnaacaaagngtttccccacaaaacaagcaccacaacgcggccgaaggacaccgcagttccaacnggaaaaagaggagagcccacaacacacgggagcataatatntgaggggggggccaagaaaacacccgcaacttaaaangcgcntggggaagagccattaggtgggnncaaccgccccgggaaaagccgcggaaaagggcccaanggaaaaacaccccaccccanccccaanaacacggggggggagaatgcatcacggggcgagatcaataccagatttcacccaaaaaacattcacaacg

SEQ ID NO: 145 - DNA, 254 bp, Homo sapiens
ctattgtgcttgcttcatcaccggccattatcagaatgttttttagaccatctagaaccacctgaaccacttgagaatctttcactgacagtaaattacagaacggtggtattacattctgctggtttaacaaggtactcaacctgatcttttctgccacttattgttaagttgctgattgcccaagcagcttctttttgtgttccaaagtcccccttagcaaggctgatgaattatcataggaattaatccag

SEQ ID NO: 146 - DNA, 825 bp, Homo sapiens
  modified_base (1)...(825): n = g, a, c or t
ctattgtgcttgcttcatcaccggccattatcagaatgttttttagaccatctagaancacctgaaccacttgagaatctttcactgacagtaaattacagaacggtggtattacattctgctgtacaaggggactcaactgatcttttctggcacttattggtaagttgctgattggccaaggcagcttctttttgtgttccaaagttccccttagcaagctgatgaattatcataggaattaatccagcatctattacagcttggnacctgttgcagggttgacctgctggataatgtttgggaaggaaacacactgggttcccttaatttatcttatctctatagggagtgataagagatatatgggaaagttgttaacaggacattacaatttgatgaacaacctgggtctgatacgtccncagntgggcccacncgcaacgcaaataagttttgggcccacaaccagggggcccacgaaaaagaggacgcagcccacgtgggnttggagaaccatcttgaaacantaccctcnggaatagagcgtcccaaanagggggcggacccaaggaanaaagggggaccaaagtaccctggaaatccacacataaaaccatactgtaatactcgtgtgccacgctgttaataccccanttcaccaacaatccactggggtcnacacaggatnanttgaaagcacacggaagagagccgccaacaaaccagngggggtgcngttntgccaagcaaccacangggtgcgctgaagtagcaataaccagganaantgggggggacgagcaacttngtaaagggtgaacg

SEQ ID NO: 147 - DNA, 463 bp, Homo sapiens
  modified_base (1)...(463): n = g, a, c or t
ctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtagtggttcctttccaacataacagcaggcaancagcaacaagttcaagctgtaatagatgctggattaattcctatgataatttcatcagcnttgctaagnggggacatattggaaacacaaaaaagaagctgcatatggggcaacaatcaggcaaanc

SEQ ID NO: 148 - DNA, 524 bp, Homo sapiens
ctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcaagaaaagatcaggttgagtaccttgtacagcagaattgtaaataccaccgttctgtaaattt

SEQ ID NO: 149 - DNA, 833 bp, Homo sapiens
  modified_base (1)...(833): n = g, a, c or t
ctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagaggggactttggaacacaaaaagaagctgcttgggcaatcagcaaacttaacaaataaagtggcagaaaagatcaggttgagtacctcgtacagcagaatgtaataccaccgatactgttaacttntacctgtcagtgaacagatcctcaagtggatcanagagggacctagaatgggtcctaaaaaaaaaacaatntctggataaattngggccgggaggacatgaaaagcaaaggcaacaaatcaaggacacggaacgagaaaccaagcanacacataggaagaccacccgntgagccaacccgggactatgaggaggggcntgccctccatgganacaggagcagcgacccaagnccaaaaaaaggggcgaatacagtagaacaagagnagnaacaacaccatacaagagagaanaacaccgacagcca

SEQ ID NO: 150 - DNA, 557 bp, Homo sapiens
ctattgtgcttgcttcatcaccggccattatcagaatgttttttagaccatctagaaccacctgaaccacttgagaatctttcactgacagtaaattacagaacggtggtattacattctgctgtacaaggtactcaacctgatcttttctgccacttattgttaagttgctgattgcccaagcagcttctttttgtgttccaaagtcccccttagcaagctgatgaattatcataggaattaatccagcatctattacagcttgaacttgttgctggttgcctgctgttatgttggaaaggaaccacactgcttccttatttatcttctcttttgggtgtgataagagatttgggaagtgtgacaggacatcacaattgagaacaacctgggtctgctcgtcggtgccagtcactatgttgccaactgctctgagggctgctgtttgaactttgacttcctgatggctcagaaggggcacaagaaagggcacaactcctgaatcaataaccatctgtatctgttcattacctccatctgtcaagtatgacagagcc

SEQ ID NO: 151 - DNA, 617 bp, Homo sapiens
ctattgtgcttgcttcatcaccggccattatcagaatgttttttagaccatctagaaccacctgaaccacttgagaatctttcactgacagtaaattacagaacggtggtattacattctgctgtacaaggtactcaacctgatcttttctaccacttattgttaagttgctgattgcccaagcagcttctttttgtgttccaaagtcccccttagcaagctgatgaattatcataggaattaatccagcatctattacagcttgaacttgttgctggttgcctgctgttatgttggaaaggaaccacactgcttccttatttatcttctcttttgggtgtgataagagatttgggaagtgtgacaggacatcacaattgagaacaacctgggtctgctcgtcggtgccagtcactatgttgccaactgctctgagggctgctgtttgaactttgacttcctgatggctcagaaggggcacaagaaagggcacaactcctgaatcaataaccatctgtatctgttcattacctccatctgtcaagtatgacagaagcccaaacagctgtctacaagaatgtttatatctgtatggtatattgaaggacaccataaag

SEQ ID NO: 152 - DNA, 624 bp, Homo sapiens
  modified_base (1)...(624): n = g, a, c or t
ctattgtgcttggcttcatcaccgggccattatcagaatgttttttagaccatctagaaccacctgaaccacttgagaatctttcactgacagtaaattacagaacggtggtattacattctgctgtacaaggtactcaacctgatcttttctgccacttattgttaagttgctgattgcccaagcagcttctttttgtgttccaaagtcccccttagcaagctgatgaattatcataggaattaatccagcatctattacagcttgaacttggttgctggttgcctgctgttatgttggaaaggaaccacactgcttccttatttatcttctcttttgggtgtgataagagatttgggaagtgtgacaggacatcacaattgagaacaactgggtctgctcgtcggtgccagtcactatgttgccaactgctctganggctgctgtttgaactttgacttcctgatggctcaaaggggcacaagaaagggcacaactcctgaatcaataaccatctgtatctgtgtcattacctccatctgtcaagtatgacagagcccaaacagtgtctacacagcaatgttctatatctcgtatggngatatgagggacacctnaaagccg

SEQ ID NO: 153 - DNA, 2245 bp, Homo sapiens
aattcgtggttccagaatcgatagggctccaagattcgccgccgccgccgccgcagccgcaggagtagccgccgccggagccgcgcgcagcatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgaccagaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccaccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagaaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcaatgtgatctgagcctccatcattgtcctccacaaacatattttcatattctttatgtggaagaatagattttaaagtacaagccaaatgattttcattggtggaactgacacaaaaaaaagtaacttaaaaacaagaaacttggttattgaataaacagataagtttt

SEQ ID NO: 154 - protein, 521 aa, Homo sapiens [sequence omitted]

SEQ ID NO: 155 - DNA, 549 bp, Homo sapiens
  modified_base (1)...(549): n = g, a, c or t
ccatttcaatactatgtggtcgttacaatgctagaggtagtgcacagggggcgcaatgcaagggaggaagggcgttaacatctgccacctacttccaggtgccaagcactgttatcaacattattccactttattcccctgggtgattatgaaaggccaggtattgagtattcacacttnacagacgaggaaaacaagcgctcagggnagaataagcgttacttganccaggtcatacaatacgttcacctagagtcccanttattctaggaaaccacaggagtttccaaaacaggggtgtttggtgttnaggaaacaatcntatggggagatatttttccaagcgcaattaccacaacattataaagtangcctccaggggggaaaatcaaaaccattccacgaaaagaaagggtngaacattctggagagcattgaaggatctttgcgcaaagaaattccttgggaaaaattttaccctgggcaaggtatgttatcaagaggggttgggtaaaggggggnaccgggagaacaagcgtttgaagcgca

SEQ ID NO: 156 - DNA, 323 bp, Homo sapiens
ccatttcaatactatgtggtcgttacaatgctagaggtaggcacagggggcgcaatgcaagggaggaagggcgttaacaattcctggcgcacgctaactttccaggtggccaaggccactggttatcaaccagttattccacgttttatttcccctgggttggaatttactggaaaaagggggccaagggggttaaattggagtattcacacttttatacagacgagggaaacaggcctcagggagataagcttacttgacccaagtctctcgtccttaggtccatatccagggaaacccaaagggaattttccaaaaccagg

SEQ ID NO: 157 - DNA, 418 bp, Homo sapiens
ccatttcaatactatgtggtcgttacaatgctagaggtaggcacagggggcgcaatgcaagggaggaagggcgttaacatctgccacctacttccaggtgccaagcactgttatcaacattattccactttattccctggtgattatgaaaggcaggtattgatattcacacttaacagacgaggaaacagcctcagggagatcaagcttacttgacccagtctctctcctagttccatatcagaaccaagattcaaacaggtttggtttagaaaatctaggatttttcagccataccaaaataaagtagcctcagggaatcaaaacattcacgaaagaaggtgacttctgaactgagtcttgcaagaattctggaaattaacctggcagttgtatcaggggtggtaaggggacggaa

SEQ ID NO: 158 - DNA, 366 bp, Homo sapiens
ccacttggatgaaaacccttcaaggattactggatagaattcaggctttcccctctagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcggtgaatgttttgattccctgaggctactttattttggtatggctgaaaaatcctagattttctaaacaaaacctgtttgaatcttggttctgatatggactaggagagagactg

SEQ ID NO: 159 - DNA, 281 bp, Homo sapiens
ccatttcaatactatgtggtcgttacaatgctagaggtaggcacagggggcgcaatgcaagggaggaagggcgttaacatctgccacctacttccaggtgccaagcactgttatcaacattattccactttattccctggtgattatgaaaggcaggtattgatatttcacacttaacagacgaggaaacagccttcagggagataagcttacttgacccagtctctcttcctagtccatatcagaaccaagattcaaacaggtttggtttagaaaatcta

SEQ ID NO: 160 - DNA, 361 bp, Homo sapiens
ccacttggatgaaaacccttcaaggattactggatagaattcaggctttcccctctagcccccaatcatagctcacaaagccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagaga

SEQ ID NO: 161 - DNA, 407 bp, Homo sapiens
  modified_base (1)...(407): n = g, a, c or t
ccacttggatgaaaacccttcaaggattactggatagaattcaggctttcccctctagcccccaagtcatagctcacaaagccttccttgctatttgttcttaagtaaaaaatcatttttcctcctccctccccaaaccccaagggaactctcactcttggctcaaggctgttccgttcgnccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcct

SEQ ID NO: 162 - DNA, 516 bp, Homo sapiens
ccatttcaatactatgtggtcgttacaatgctagaggtaggcacagggggcgcaatgcaagggaggaagggcgttaacatctgccacctacttccaggtgccaagcactgttatcaacattattcccactttattccctggtgattatgaaaggcaggtattgatattcacacttaacagacgaggaaacagcctcagggagataagcttacttgacccagtctctctcctagtccatatcagaaccaagattcaaacaggttttgtttagaaaatctaggatttttcagccataccaaaataaagtagcctcagggaatcaaaacattcacgaaagaaggtgacttctgaactgagtcttgcaagaattctggaaattaacctggcagttgtatcaggggtggtaaggggacggaacagcttgagcaagagtgagagttccttggggtttggggagggaggaggaaaaatgattttttacttaagaacaaatagcaaggaaggtttgtgagctat

SEQ ID NO: 163 - DNA, 3502 bp, Homo sapiens
acatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgcggtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcactgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaacaaa

SEQ ID NO: 164 - protein, 563 aa, Homo sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 165 - DNA, 602 bp, Homo sapiens
cggaccaacacagtattgagtcaactgtgaccttaagatcagaggaacgtcaatactgccacaaggccacctttccagaactcgtgggcaggtaaactatgctttggatgtgctttctttcaccaaaatcactcaactcaggagccacaaatagtccagcaatttcatttccctcaacgctattttagtctcaaaggaaaccatgtaaatttcatcaagagaaggtcaaaggggatatatcgccactgaaaatgtttacacagtgaccatgagttacacatttacttagagaaacttaacttaataaagaatctgtagagtgtgttggcttggaaaacacacacacaaagaagatacctcacgcttagtatgttctgctttctgaacagccaccactgggaacccagtggcctctgtgggactgaactcctaaacgcagggtgcgggagctgggcaggagaggtgacctccaactgtgttcctaaagttcgtctttcgcttggctcaggacaaagcggtgtaacgagtcaaagtctctgcctccactgtgctcactgactttcttccctcctcggaaaagcaataacgtggggtagcctcgt

SEQ ID NO: 166 - DNA, 105 bp, Homo sapiens
ccacctccatttctggaggcagacatacgttcttgatgagaactacttctgtttctggaggtggagtcacatccttgcccagagccatttctgtttctgatagtg

SEQ ID NO: 167 - DNA, 105 bp, Homo sapiens
cactatcagaaacagaaatggctctgggcaaggatgtgactccacctccagaaacagaagtagttctcatcaagaacgtatgtctgcctccagaaatggaggtgg

SEQ ID NO: 168 - DNA, 105 bp, Homo sapiens
  modified_base (1)...(105): n = g, a, c or t
ccacctccatttctggaggcagacatacgttcttgatgagaactacttctgtttctggaggtggagtcanatccttgcccagagccatttctgtttctgatagtg

SEQ ID NO: 169 - DNA, 4779 bp, Homo sapiens
tgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccatcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatgaattc

SEQ ID NO: 170 - protein, 1152 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETITGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 171 - DNA, 4665 bp, Homo sapiens
tgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccatcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggttcagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatgaattc

SEQ ID NO: 172 - protein, 1114 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETITGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 173 - DNA, 4471 bp, Homo sapiens
tgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccatcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaaattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatgaattc

SEQ ID NO: 174 - protein, 1082 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETITGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETN

SEQ ID NO: 175 - DNA, 4348 bp, Homo sapiens
tgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacgttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccatcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaaattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatgaattc

SEQ ID NO: 176 - protein, 1041 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETITGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETN

SEQ ID NO: 177 - DNA, 326 bp, Homo sapiens
  modified_base (1)...(326): n = g, a, c or t
ctcataagacgaagcttcacaaaagatgtctaagcaacagccaactcagtttataaatccagaaacaccttggctatgttggatttgcaaacctccccagaatcaagttcaccgaaaatcagtgaaaaaaggtttatgagttcacactgataggtgngtcggtgaatcaggtctaggacaacatcgactctcataaacnagcctattcctaactgatctgtacccagaaagagtcatacctgagtagcagcaggtaataaacattgaaaggaactgtccagattgaggcttcaaactgttgacaattgaagagcgaggggtcaatg

SEQ ID NO: 178 - DNA, 328 bp, Homo sapiens
  modified_base (1)...(328): n = g, a, c or t
cttgacccctcgctcttcaatttcaacatgttgaagcctcaaatcctgggacaggttctttcaattttttcttgctgcgtccaggtatgactcgtttctgggtacagatcagttaggaataggctgnttatgagagtcgatatttcctagacctgattcaccgaccaccatcagttgtgaactcataaaccttttttcactgatttttcggtgaacttgattggggaggtttgcnaattnccacatagcccggtgttntctggatttataaagctgagttggctgttgctatacggacctctatatttgtgaagcttcgtcttatgag

SEQ ID NO: 179 - DNA, 307 bp, Homo sapiens
  modified_base (1)...(307): n = g, a, c or t
cttganccctcgctcttcaatttcaacagttgaagcctcaatctggacagttctttcaattttttctgctgctccaggtatgactctttctgggtacagatcagttaggaataggctgtttatgagagtcgattttcctagacctgattcaccgaccaccatcagtgtgaactcaaaaccttttttcactgattttcggtgaacttgattggggaggtttgcaaatccaacatagccaggtgtttctggatttataaactgagttggctgttgcttagacatcttttgtgaagcttcgtcttatgag

SEQ ID NO: 180 - DNA, 307 bp, Homo sapiens
ctcataagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaag

SEQ ID NO: 181 - DNA, 302 bp, Homo sapiens
ctcataagacgaagcttcacaaaagatgtctaagcaacagccaactcagtttataaatccagaaacacctggctatgttggatttgcaaacctccccatcaagttcaccgaaatcagtgaaaaaaggttttgagttcacactgatgtggtcggtgaatcaggtctaggaaaatcgactctcataaacagcctattcctaactgatctgtacccgaaagagtcatacctgagcagcagaaaaaattgaaagaactgtccagattgaggcttcaactgttgaaattgaagagcgaggggtcaag

SEQ ID NO: 182 - DNA, 307 bp, Homo sapiens; identical to SEQ ID NO: 180

SEQ ID NO: 183 - DNA, 3433 bp, Homo sapiens
cccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttccgtattgcaaataagactcttacctacaaaatgagattccagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcttgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatt

SEQ ID NO: 184 - protein, 361 aa, Homo sapiens
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 185 - DNA, 469 bp, Homo sapiens
  modified_base (1)...(469): n = g, a, c or t
cagggggtgctgaaggccctcgaactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggnttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccctgctgaggagctgaccatgagcccttcgcgctcagtggccaactctggcctgagtgacagcctgaccaccagcacccc

SEQ ID NO: 186 - DNA, 456 bp, Homo sapiens
cagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccctgctgaggagctgaccatgagcccttcgcgctcagtggccaactctggcctgagtgacagcctgacc

SEQ ID NO: 187 - DNA, 461 bp, Homo sapiens
  modified_base (1)...(461): n = g, a, c or t
cagaggctcagaactcccaatcgtccacctccagctcttccaggtttgttaccaggccaaagattccactgtggtcctgagactggctgccctcaaaattggtgatgggggtgacaggacgaagcaattcgggcaaagcctctgaggcacgtcgcttgatctgggggagaagagagaggtgggtgacagatcctgttgctctgggtcccagnacaccatggggcaaggaaccatggcctgntggcagacgggctgtcggagccaactccatgagaggaaggagcagtgtctttcaggggcttcggaagnggggtagtttctctcattcaaaangaggggagagaaanctggcatccgggttgcgctgaaggcactgctccacaaagtggtggaagtggggggagaaggttcggtggtaggggtgggagggcgagtcaccgtaggngggccggggggtgctg

SEQ ID NO: 188 - DNA, 461 bp, Homo sapiens
  modified_base (1)...(461): n = g, a, c or t
cagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccctgctgaggagctgaccatgagcccttcgcgctcagtggccaactctggcctgagtgncagcctgaccaacag

SEQ ID NO: 189 - DNA, 350 bp, Homo sapiens
cagaggctcagaactcccaatcgtccacctccagctcttccaggtttgttaccaggccaaagattccactgtggtcctgagactggctgccctcaaaattggtgatgggggtgacaggacgaagcaattcgggcaaagcctctgaggcacgtcgcttgatctgggggagaagagagaggtgggtgacagatcctgttgctctgggtcccaggacaccatggggcaaggaaccatggcctggtggcagacgggctgtcggagccaactccatgagaggaaggagcagtgtctttcaggggcttcggaagcggggtagtttctctcattcaaaaggaggggagagaaagctg

SEQ ID NO: 190 - DNA, 647 bp, Homo sapiens
  modified_base (1)...(647): n = g, a, c or t
cagaggctcagaactcccaatcgtccacctccagctcttccaggtttgttaccaggccaaagattccactgtggtcctgagactggctgccctcaaaattggtgatgggggtgacaggacgaagcaattcgggcaaagcctctgaggcacgtcgcttgatctgggggagaagagagaggtgggtgacagatcctgttgctctgggtcccaggacaccatggggcaaggaaccatggcctggtggcagacgggctgtcggagccaactccatgagaggaaggagcagtgtctttcaggggcttcggaagcggggtagtttctctcattcaaaaggaggggagagaaagctggcatccgggttgcgctgaaggcactgctccacaaagtggtggaagtggggggagaaggttcggtggtaggggtgggagggcgagtcaccgtnggagggccggggggtgctggtggtcangctgtcactcaggccagagttggncactgatcgcgaanggctcatggtcagntcctcancagggatggtgctggtatccaacaggcagggcactgtgccgttcagtttctctnagcagcatctgggtggcaggcatatccttaaaggggacatggccgttggccactcacaggcctgt

SEQ ID NO: 191 - DNA, 461 bp, Homo sapiens
cagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccctgctgaggagctgaccatgagcccttcgcgctcagtggccaactctggcctgagtgacagcctgaccaccag

SEQ ID NO: 192 - DNA, 545 bp, Homo sapiens
  modified_base (1)...(545): n = g, a, c or t
cagaggctcagaactcccaatcgtccacctccagctcttccaggtttgttaccaggccaaagattccactgtggtcctgagactggctgccctcaaaattggtgatgggggtgacaggacgaagcaattcgggcaaagcctctgaggcacgtcgcttgatctgggggagaagagagaggtgggtgacagatcctgtngctctgggtcccaggacaccatggggcaaggaaccatggcctggtggcaganngactgtcatagccaacnccatgagaggaaggagcagtgtctttcaggggcttcggaagcggggtagtttctctcattcaaaaggaggggagagaaagctggcatccgggttgcgctgaaggcactgctccacaaagtggtggaagtggggggagaaggttcggtggtaggggtgggagggcgagtcaccgttggagggccggggggtgctggtggtcaggctgtcactcangccagagttggccactgaccgcgaagggctcatggtcagttcctcancagggatggtgctggta

SEQ ID NO: 193 - DNA, 469 bp, Homo sapiens
cagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccctgctgaggagctgaccatgagcccttcgcgctcagtggccaactctggcctgagtgacagcctgaccaccagcacccccc

SEQ ID NO: 194 - DNA, 365 bp, Homo sapiens
  modified_base (1)...(365): n = g, a, c or t
cagggggtgctgaaggccctcgactacgtccaccacatgggatatgtacacaggagtgtcaaagccagccacatcctgatctctgtggatgggaaggtctacctgtctggtttgcgcagcaacctcagcatgataagccatgggcagcggcagcgagtggtccacgatttncccaagtacagtgtcaaggttctgccgtggctcagccccgaggtcctccagcagaatctccagggttatgatgccaagtctgacatctacagtgtgggaatcacagcctgtgaactggccaacggncatgtcccctttaaggatatgcctgccacccatatgctgctagagaaactgaacggcacagtgccctg

SEQ ID NO: 195 - DNA, 466 bp, Homo sapiens
cagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccctgctgaggagctgaccatgagcccttcgcgctcagtggccaactctggcctgagtgacagcctgaccaccagcaccc

SEQ ID NO: 196 - DNA, 658 bp, Homo sapiens
cagaggctcagaactcccaatcgtccacctccagctcttccaggtttgttaccaggccaaagattccactgtggtcctgagactggctgccctcaaaattggtgatgggggtgacaggacgaagcaattcgggcaaagcctctgaggcacgtcgcttgatctgggggagaagagagaggtgggtgacagatcctgttgctctgggtcccaggacaccatggggcaaggaaccatggcctggtggcagacgggctgtcggagccaactccatgagaggaaggagcagtgtctttcaggggcttcggaagcggggtagtttctctcattcaaaaggaggggagagaaagctggcatccgggttgcgctgaaggcactgctccacaaagtggtggaagtggggggagaaggttcggtggtaggggtgggagggcgagtcaccgttggagggccggggggtgctggtggtcaggctgtcactcaggccagagttggccactgagcgcgaagggctcatggtcagctcctcagcagggatggtgctggtatccaacaggcagggcactgtgccgttcagtttctctagcagcatctgggtggcaggcatatccttaaaggggacatggccgttggccagttcacaggctgtgattcccacact

SEQ ID NO: 197 - DNA, 466 bp, Homo sapiens
cagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccgcccagatgctgctagagaaactgaacggcacagtgccctgcctgttggataccagcaccatccctgctgaggagctgaccatgagcccttcgcgctcagtggccaactctggcctgagtgacagcctgaccaccagcaccc

SEQ ID NO: 198 - DNA, 418 bp, Homo sapiens
cagaggctcagaactcccaatcgtccacctccagctcttccaggtttgttaccaggccaaagattccactgtggtcctgagactggctgccctcaaaattggtgatgggggtgacaggacgaagcaattcgggcaaagcctctgaggcacgtcgcttgatctgggggagaagagagaggtgggtgacagatcctgttgctctgggtcccaggacaccatggggcaaggaaccatggcctggtggcagacgggctgtcggagccaactccatgagaggaaggagcagtgtctttcaggggcttcggaagcggggtagtttctctcattcaaaaggaggggagagaaagctggcatccgggttgcgctgaaggcactgctccacaaagtggtggaagtggggggagaaggttcggtggta

SEQ ID NO: 199 - DNA, 465 bp, Homo sapiens
cagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccctgctgaggagctgaccatgagcccttcgcgctcagtggccaactctggcctgagtgacagcctgaccaccagcacc

SEQ ID NO: 200 - DNA, 573 bp, Homo sapiens
cagaggctcagaactcccaatcgtccacctccagctcttccaggtttgttaccaggccaaagattccactgtggtcctgagactggctgccctcaaaattggtgatgggggtgacaggacgaagcaattcgggcaaagcctctgaggcacgtcgcttgatctgggggagaagagagaggtgggtgacagatcctgttgctctgggtcccaggacaccatggggcaaggaaccatggcctggtggcagacgggctgtcggagccaactccatgagaggaaggagcagtgtctttcaggggcttcggaagcggggtagtttctctcattcaaaaggaggggagagaaagctggcatccgggttgcgctgaaggcactgctccacaaagtggtggaagtggggggagaaggttcggtggtaggggtgggagggcgagtcaccgttggagggccggggggtgctggtggtcaggctgtcactcaggccagagttggccactgagcgcgaagggctcatggtcagctcctcagcagggatggtgctggtatccaacaggcagggcactgtgccgttca

SEQ ID NO: 201 - DNA, 169 bp, Homo sapiens
  modified_base (1)...(169): n = g, a, c or t
cagggggtgctgaaggccctcgactacatccaccacatgggatatgtacacaggagtgtcaaanccagncacatcctgatctctgtggatgggaaggtctacctgtctggtttgcgcagcaacctcagcatgataagccatgggcagcggcagcnagtggtccangann

SEQ ID NO: 202 - DNA, 2143 bp, Homo sapiens
gcggcgcggcagtaaaactgaggaggcggagccaagacggtcggggctgcttgctaactccaggaacaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggagagcagcctccgggtgacactcggagaaaaaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaa

SEQ ID NO: 203 - protein, 431 aa, Homo sapiens
MSFLVSKPERIRRWVSEKFIVEGLRDLELFGEQPPGDTRRKTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 204 - DNA, 760 bp, Homo sapiens
  modified_base (1)...(760): n = g, a, c or t
atctacatgaggtcctgtagattgagcaactttggctatttgggtagctgatccactgccaagctggctcccagctaccacctgttactttgacaactctagcttcagggctaccaggaccatttgcaaaacttacacccacagaaaactcaaagtctccagaggcataagctccaatcccccagagagctcgcactagcattcttctccctttctagtagtacttttatgggggggagttattcttccccacaaaagtgagcggcgacaataaaaacaatgtttcccacaaagagttttccccggttcttctcccaaaaatttngggggggcccccgtttntcccccgggcgacgggggcgggngggcccgccccccaaaaccacaanggnggtgtgttccctctgaaagctcnnacaaagaggggtgaccccccccggttttgggtgatgaataccgcccgaagataggncgcccgaaaaagagccaacccnngaaaagagagatttttatatagaggaagcaaaaacgaaanganagcggtttttttttttttgtccngccaacaacatggggggcccccgttttataaatagagttttttgttttttaaacaatcgactttttttttccccccgtgtatttaaaaaagaaggaagggtattttatattnttgggggngcgtgtattatataaattatttagtggggtgcgggganggaaagagngaagctgtttatcccatcaaaatattattgtg

SEQ ID NO: 205 - DNA, 404 bp, Homo sapiens
tctacatgaggtcctgtagattgagcaactttggctatttgggtagctgatccactgccaagctggctcccagctaccacctgttactttgacaactctagcttcagggctaccaggaccatttgcaaaacttacacccacagaaaactcaaagtctccagaggcataagctccaacccccagagagctccacagcattcttctccttctagtagtacttttggtttccaggaaaatcatctcatgctcgggccacagtcacagtcctgaccagcaccatagaaatttcagccattattctagttgtatggagtcattcaaaatactagttccgaaagaagtttcaaaggtccaacgccgagcatcttttacctttgctaatttttccataaattgaaagcctt

SEQ ID NO: 206 - DNA, 392 bp, Homo sapiens
atctacatgaggtcctgtagattgagcaactttggctatttgggtagctgatccactgccaagctggctcccagctaccacctgttactttgacaactctagcttcagggggctaccaggaccatttgcaaaacttacacccacagaaaactcaaagtctccagaggcataagctccaacccccagagagctccacagcattcttctccttctagtagtacttttggtttccaggaaaatcatctcatgctcgggccacagtcacagtcctgaccagcaccatagaaatttcagccattattctagttgtatggagtcattcaaaatactagttccgaaagaagtttcaaaggtccaacgccgagcattctttttacctttgctaatttttc

SEQ ID NO: 207 - DNA, 297 bp, Homo sapiens
atctacatgaggtcctgtagattgagcaactttggctatttgggtagctgatccactgccaagctggctcccagctaccacctgttactttgacaactctagcttcagggctaccaggaccatttgcaaaacttacacccacagaaaactcaaagtctccagaggcataagctccaacccccagagagctccacagcattcttctccttctagtagtacttttggtttccaggaaaatcatctcatgctcgggccacagtcacagtcctgaccagcaccatagaaatttcagccatt

SEQ ID NO: 208 - DNA, 406 bp, Homo sapiens
atctacatgaggtcctgtagattgagcaactttggctatttgggtagctgatccactgccaagctggctcccagctaccacctgttactttgacaactctagcttcaggggctaccaggaccatttgcaaaacttacacccacagaaaactcaaagtctccagaggcataagctccaacccccagagagctccacagcattcttctccttctagtagtacttttggtttccaggaaaatcatctcatgctcgggccacagtcacagtcctgaccagcaccatagaaatttcagccattattctagttgtatggagtcattcaaaatactagttccgaaagaagtttcaaaggtccaacgccgagcatcttttacctttgctaatttttccataaattgaaagcctt

SEQ ID NO: 209 - DNA, 434 bp, Homo sapiens
  modified_base (1)...(434): n = g, a, c or t
aatctacatgaggtcctgtagattgagcaactttggctatttgggtagctgatccactgccaagctggctcccagctaccacctgttactttgacaactctagcttcaggctacaggacatttgcaaaacttacacccacagaaaactcaaagtctccagaagcataagctccaaaccccaganagctccaagattcttctccttctagtagtacttttggtttccaggaaaatcatctcatgctcgggccacagtcacagtcctgaccagcaccatagaaatttcagcattattctagttgtatgtgagtccttccaaatactagttccgaaagaagtttccaaggtccaacgccgagcatcttttacnttggtaatttttccctaaattgaaagccttccgcagaaaccagcacagtggttagatagataaa

SEQ ID NO: 210 - DNA, 405 bp, Homo sapiens
atctacatgaggtcctgtagattgagcaactttggctatttgggtagctgatccactgccaagctggctcccagctaccacctgttactttgacaactctagcttcagggctaccaggaccatttgcaaaacttacacccacagaaaactcaaagtctccagaggcataagctccaacccccagagagctccacagcattcttctccttctagtagtacttttggtttccaggaaaatcatctcatgctcgggccacagtcacagtcctgaccagcaccatagaaatttcagccattattctagttgtatggagtcattcaaaatactagttccgaaagaagtttcaaaggtccaacgccgagcatcttttacctttgctaatttttccataaattgaaagcctt

SEQ ID NO: 211 - DNA, 1028 bp, Homo sapiens
  modified_base (1)...(1028): n = g, a, c or t
gcgtcgctcggcgttagccaaggcccgggcggcgccaccctccgggggcactaggtctggggccgcagtgcccccccataggcacacacgagngaaagcgccaatgggcctgggttttttttaaatttcccgggcggggcgnaaccccggaacacaacgggcaaacttgtacaatttttgtggggancaacaaccgggacacaantttttggggnaatggcgccacaaaaaaanaaaccaacgacgcgacgaaagcgcgtggtgtttgtgcngaatactttttataaaaccaccaaatgggcgcctctcgcttgtgccgcccccttctccccaaanggggggcggcgctgttttttccccaacacgggcgtggggcccaaaaaaaattgtgggcgcccaaagaaaaaatattttaataaaacagaggcggccccccacaacacaggcggttntgggggaacaggaaaccaacacaacgacaacacggcgctggcggcaacaagcaaacacgggagcaaacaaaacacgggcggaaagaaaccacacgggcgaaacgacttttataacaaacacttttgttggggcgcaaacagcacacacacaaccaaaatgggcgcccccccccnccgagggggcccacaaaggncgaagagaaaaaaccacccccccccaaaaagagagcgcccgcaaaacaaccaccaaaaaaaggggaggagtttggagagcagggcgagangtttttttatattaaaacacgggcnacgaaaacatcattttataaatagggcaggcaaaaaacacgatttataatatttcaacagaaaacagggntggcctctgggggtttggtgtgtgtgcttcccnaccggtggtgcgcgtgtttttcctcctggtgnggaaaaaagacacctgttttataaaagaggagngtattnccncctttttgtgggtgcgaaaaacagacgngaggcgggangatntatcccactcttttggtggtgcaacaagtgttttatatagnatacctg

SEQ ID NO: 212 - DNA, 236 bp, Homo sapiens
  modified_base (1)...(236): n = g, a, c or t
gcgttgctcggcgttagccaagggcccgggcggcgccaccctccgggggcactaggtctggggccgcagtgcccagncacagagcagcgtttatctgggacgaagatgaatggaaagaattggagcaaaaagaggttgattacagcgggctcangggttcaggcgaatgcaaataagcacgtgaaaaggaagaagacgataatgaaaagccgcagaaaccagcacagtggttagat

SEQ ID NO: 213 - DNA, 315 bp, Homo sapiens
caagccggtgcagcggttgtcagtgtgctgggtctgcgggcgttgcttcggcgttagccaagccgggcggcgccaccctccggggggggggccactaggtctggggccgcagtgcccagcacagagcagcggtttatcgggacgaagaatgaattggaaagaattggagcaaaaagaggttgataacagcggcctcaggggttcaggcaatgcaaataagcagtgaaaaggaagaagacgataatgaaaagccgcagaaaccagcacagtggttagatagataaagcgggcgctcgactagtctgaggtctgata

SEQ ID NO: 214 - DNA, 193 bp, Homo sapiens
gcgtgctcggcgttagccaatgcccgggcggcgccacctccgggggcactaggtcttggggccgcagtgcccagcacagagcagcgtttatcgggacgaagatgaatggaaagaattggagcaaaaagaggttgattacagctggcctcagggggttcaggcaatgcaaataagcagtgaaaaggaagaagac

SEQ ID NO: 215 - DNA, 203 bp, Homo sapiens
gcgtcgctcggcgttagccaaggcccgggcggcgccaccctccgggggcactaggtctggggccgcagtgcccagcacagagcagcgtttatcgggacgaagatgaatggaaagaattggagcaaaaagaggttgattacagcggctcaggggttcaggcaatgcaaataagcagtgaaaaggaagaagacgataatgaaaag

SEQ ID NO: 216 - DNA, 204 bp, Homo sapiens
gcgtcgctcggcgttagccaaggcccgggcggcgccaccctccgggggcactaggtctggggccgcagtgcccagcacagagcagcgtttatcgggacgaagatgaatggaaagaattggagcaaaaagaggttgattacagcggcctcaggggttcaggcaatgcaaataagcagtgaaaaggaagaagacgataatgaaaag

SEQ ID NO: 217 - DNA, 203 bp, Homo sapiens
cttttcattatcgtcttcttccttttcactgcttatttgcattgcctgaaccctgaggccgctgtaatcaacctctttttgctccaattctttccattcatcttcgtcccgataaacgctgctctgtgctgggcactgcggccccagacctagtgcccccggagggtggcgccgcccgggcctcggctaacgccgagcgacgc

SEQ ID NO: 218 - DNA, 204 bp, Homo sapiens; identical to SEQ ID NO: 216

SEQ ID NO: 219 - DNA, 527 bp, Homo sapiens
cttgccattccactccagcctgggcaacgagagcgaaactctgtctcaaaaagaaaagaaaaggaaagaaaaaccacctcccaccaggttaaataaataattaacattttggtatgtacccttccagacattttcctatgcatcacatcaataaatatatgataggatattttacatttgatgtatcctgaagattaattcaacaaatgtttagtgagtaggcttgttgtaggtgctgggaattcagcagtgaacaaaacaaagtctctgcctcatggagctcatattatagtagggaagactgtcaataagcaatatacacattgactaaatgatagataatgcccagtaatgtggcaagttttatggaaaaataaatcaggataaaaggataagagtgatatggggattctcttagttagggtagataaggaaggcctcttagctaaggaggcacataaatatctgatcatctaatgagagaaggagcaacatgggatttctagagggaaactatcctagaaaga

SEQ ID NO: 220 - DNA, 645 bp, Homo sapiens
  modified_base (1)...(645): n = g, a, c or t
ctgcttctcttctaggatagtttccctctagaaatccatgttgctccttctctcattaaatgatcagatatttatgtgcctccttagctaagaggccttccttatctaccctaactaagagaatccccatatcactcttatccttttatcctgatttatttttccataaaacttgccacattactgggcattatctatcatttagtaatgtgtatattgcttattgacagtcttccctactataatatgagctccatgaggcagagactttgttttgttcactgctgaattcccagcacctacaacaagcctactcactaaacatttgttgaattaatcttcaggatacatcaaatgtaaaaatatcctatcatatatttattgatgtgatgcataggaaaatgtctggaagggtacataccaaaatgttaattatttatttaacctggtgggaggtggattatttctttccttttctttctttttgagaccagagtttccgcatcttcgttgccccaggctgggagtggaaattgggcaaagcccgcagaaaccccaagcaacaagtgggtttagatagnatcaaagcgggccgctcgacttaantccttgaaggtctgattactcaacctgacttgtcagaaa

SEQ ID NO: 221 - DNA, 613 bp, Homo sapiens
  modified_base (1)...(613): n = g, a, c or t
cttgccattccactccagcctgggcaacgagagcgaaactctgtctcaaaaagaaaagaaaaggaaagaaaaaccacctcccaccaggttaaataaataattaacattttggtatgtacccttccagacattttcctatgcatcacatcaataaatatatgataggatattttacatttgatgtatcctgaagattaattcaacaaatgtttagtgagtaggcttgttgtaangtgctgggaattcagcagtgaacaaaacaaagtctctgcctcatggagctcatattatagtagggaagactgtcaataagcaatatacacattactaaatgatagataatgcccagtaatgtggcaagttttatggaaaaattaatcaggataaaggataagagtgatatggggattctcttaattagggtagatnaggaagggctctttagctnaaggaagcaacataaatatctgatcattttaaaangggaaggaacgaaaaaggggaaagccaaaacacaaatgggggacaatttataccttacgaaaagggggaaaaaaccataaaatcccctaaggaaacanaaaagcaaaagcncaaagaccagcaaaaacaa

SEQ ID NO: 222 - DNA, 415 bp, Homo sapiens
cttgccattccactccagcctgggcaacgagagcgaaactctgtctcaaaaagaaaagaaaaggaaagaaaaaccacctcccaccaggttaaataaataattaacattttggtatgtacccttccagacattttcctatgcatcacatcaataaatatatgataggatattttacatttgatgtatcctgaagattaattcaacaaatgtttagtgagtaggcttgttgtaggtgctgggaattcagcagtgaacaaaacaaagtctctgcctcatggagctcatattatagtagggaagactgtcaataagcaatatacacattactaaatgatagataatgcccagtaatgtggcaagtttatatggaaaaataaatcaggataaaaggataagagtgatatggggattctct

SEQ ID NO: 223 - DNA, 713 bp, Homo sapiens
  modified_base (1)...(713): n = g, a, c or t
ctgcttctcttctaggatagtttccctctagaaatccatgttgctccttctctcattaaatgatcagatatttatgtgcctccttagctaagaggccttccttatctaccctaactaagagaatccccatatcactcttatccttttatcctgatttatttttccataaaacttgccacattactgggcattatctatcatttagtaatgtgtatattgcttattgacagtcttccctactataatatgagctccatgaggcagagactttgttttgttcactgctgaattcccagcacctacaacaagcctactcactaaacatttgttgaattaatcttcaggatacatcaaatgtaaaatatcctatcatatatttattgatgtgatgcataggaaaatgtctggaagggtacataccaaaatgttaattatttatttaacctggtgggaggtggtttttctttccttttcttttctttttgagacagagtttacgctctcgtgtgcccaggcctggagtggaatggcaagccgcagaanccagcacagtggttangatnaattaaagcgggcnagtccaataagtctgaaggctgaaacacacacacagagacggtcacaaagggcgaaatncggcaaaatnccatcccactgggggccgcatcacaaaatgnatngagaaggggaccaaatggccaaagangagcgat

SEQ ID NO: 224 - DNA, 462 bp, Homo sapiens
ctgcttctcttctaggatagtttccctctagaaatccatgttgctccttctctcattaaatgatcagatatttatgtgcctccttagctaagaggccttccttatctaccctaactaagagaatccccatatcactcttatccttttatcctgatttatttttccataaaacttgccacattactgggcattatctatcatttagtaatgtgtatattgcttattgacagtcttccctactataattatgagctccatgaggcagagactttgttttgttcactgctgaattcccagcacctacaacaagcctactcactaaacatttgttgaattaatcttcaggatacatcaaatgtaaaatatcctatcatatatttattgatgtgatgcataggaaaatgtctggaagggtacataccaaaatgttaattatttatttaacctggtgggaggtggtaa

SEQ ID NO: 225 - DNA, 599 bp, Homo sapiens
  modified_base (1)...(599): n = g, a, c or t
ctgcttctcttctaggatagtttccctctagaaatccatgttgctccttctctcattagatgatcagatatttatgtgcctccttagctaagaggccttccttatctaccctaactaagagaatccccatatcactcttatccttttatcctgatttatttttccataaaacttgccacattactgggcattatctatcatttagtaatgtgtatattgcttattgacagtcttccctactataatatgagctccatgaggcagagactttgttttgttcactgctgaattcccagcacctacaacaagcctactcactaaacatttgttgaattaatcttcaggatacatcaaatgtaaaatatcctatcatatatttattgatgtgatgcataggaaaatgtctggaagggtacataccaaaatgttaattatttatttaacctggtgggaggtggtttttctttccttttctttncttattgagacagagtttcgctctcgttgccccggctggaagtggaatggcaagccggcaggaacccaagacaacaaggaggttaagatcagaataaaagacggggaccgcatccagaaac

SEQ ID NO: 226 - DNA, 537 bp, Homo sapiens
  modified_base (1)...(537): n = g, a, c or t
cttgccattccactccagcctgggcaacgagagcgaaactctggtctcaaaaagaaaggaaaaggaaagaaaaaccacctcccaccagggttaaataaataattaacattttggtatgtacccttccaggacattttcctatgcatcacatcaataaatatatgataggatattttacatttgatgtatcctgaagattaattcaacaaatgtttagtgagtaggcntgttagtaggtgctgggaattcagcagtgaacaaaacaaagtctctgcctcatggagctcatattatagtagggaagactgtcaataagcaatatacacattactaaatgatagataatgcccagtaatgtggcaagttttatggaaaaatnaatcaggataaaaggataagagtgatatggggattctncttagattagggtagataaaggaangcctcttagnctnaagaggccacataaacaaaatcaattccttgggaaaatccaanctgnctaaacgtagacagggacaagcaanaggcggacgg

SEQ ID NO: 227 - DNA, 531 bp, Homo sapiens
ctgcttctcttctaggatagtttccctctagaaatccatgttgctccttctctcattaaatgatcagatatttatgtgcctccttagctaagaggccttccttatctaccctaactaagagaatccccatatcactcttatccttttatcctgatttatttttccataaaacttgccacattactgggcattatctatcatttagtaatgtgtatattgcttattgacagtcttccctactataatatgagctccatgaggcagagactttgttttgttcactgctgaattcccagcacctacaacaagcctactcactaaacatttgttgaattaatcttcaggatacatcaaatgtaaaatatcctatcatatatttattgatgtgatgcataggaaaatgtctggaagggtacataccaaaatgttaattatttatttaacctggtgggaggtggtttttctttccttttcttttctttttgagacagagtttcgctctcgttgcccaggctggagtggaatggcaag

SEQ ID NO: 228 - DNA, 336 bp, Homo sapiens
gcttgcaaaggagaggctgtgactaccaaggtcgtgtcaacaactgaatggctgaaatacccaaacttgcccatgcaaatgggcttgggtctctcctggcagccgcctttgaaggctctagacttatctgtgaactccttttttgagagggtctttccaactagtggtttattctttgactctcctcataccttttttgccagagagtgagagtgagaagggagggctaatgcctgagctcctgccctttctatgcagtgagggtcaagatcctcagctagtgtttgagggaactggtgtaacctgggtctctcattttctaccatccaagttgcc

SEQ ID NO: 229 - DNA, 336 bp, Homo sapiens
  modified_base (1)...(336): n = g, a, c or t
ggcaacttggatggtagaaaatgagagacccaggttacaccaggttccctcaaacactagctgaggatcttgaccctcactgcntagaaagggcaggagctcaggcattagccctcccttctcactctcactctctggcaaaaaaggtatgaggagagtcaaagaataaaccactagttggaaagaccctctcaaaaaaggagttcacagataagtctagagccttcaaaggcggctgccaggagagacccaagcccatttgcatgggcaagtttgggtatttcagccattcagttgttgacacgacttggtagtcacagcctctcctttgcaagc

SEQ ID NO: 230 - DNA, 335 bp, Homo sapiens
gcttgcaaaggagaggctgtgactaccaagtcgtgtcaacaactgaatggctgaaatacccaaacttgcccatgcaaatgggcttgggtctctcctggcagccgcctttgaaggctctagacttatctgtgaactccttttttgagagggtctttccaactagtggtttattctttgactctcctcataccttttttgccagagagtgagagtgagaagggagggctaatgcctgagctcctgccctttctatgcagtgagggtcaagatcctcagctagtgtttgagggaactggtgtagcctgggtctctcattttctaccatccaagttgcc

SEQ ID NO: 231 - DNA, 249 bp, Homo sapiens
  modified_base (1)...(249): n = g, a, c or t
ggcaacttggatggtagaaaatgagagacccaggctacaccagnttccctcaaacactagctgaggatcttgaccctcactgcatagaaagggcaggagctcaggcattagccctcccttctcactctcactctctggcaaaaaaggtatgaggagagtcaaanaataaaccactanttgganagaccctctcaanaaaggagttcacagataantntatagccttcaaaggcggctgccaggagagac

SEQ ID NO: 232 - DNA, 335 bp, Homo sapiens
gcttgcaaaggagaggctgtgactaccaagtcgtgtcaacaactgaatggctgaaatacccaaacttgcccatgcaaatgggcttgggtctctcctggcagccgcctttgaaggctctagacttatctgtgaactccttttttgagagggtctttccaactagtggtttattctttgactctcctcataccttttttgccagagagtgagagtgagaagggagggctaatgcctgagctcctgccctttctatgcagtgagggtcaagatcctcagctagtgtttgagggaactggtgtaacctgggtctctcattttctaccatccaagttgcc

SEQ ID NO: 233 - DNA, 778 bp, Homo sapiens
  modified_base (1)...(778): n = g, a, c or t
ctggccgcacgcagctcttttcctggggatcccagatggttgtgcgctgggggcctggcggaggtccgagtcgggttggatggctgtgtccgtcgccatgtttgtgtggtgcctggccccgtggtcccatgttctggcagcttctggctccagcctcagcctgtagtggggtgttacgtggtagngagtgcggtagctgggggcctgcagtggggtaggtcagtggtaggagtgcagntagcatagaagttanaaaggttactagtagagactggtcccatacttagagatgggacaccatgacctgatggntacnaccctgacaggccgcagaaaccagacacactggagccaccgactgacacaacgggccntgggnacggacgtccaatngcgtatgantaccangacagtcagganccccaaatgacccggaagcaggaaacggggcagaaaaaancaatagccaaggaatagtcacanggtcgacanaacctgngcagggaccagnaaaccagaangaccaatgcacantacataagaagggggggggcacnccacaaaagatatgccgggcgacgccagataagataagggactagggaaggagtccgggnaaanatgtaacgaaagagtatcgaaccaatggagggncgccgggtacccgngcgnaaggacaaacaanaagcaggcatccggactgggaaccaatgggggggaaagaagcagcgcccccatgggganagggatgtaaanccacaacaacacgtgtnaaacg

SEQ ID NO: 234 - DNA, 659 bp, Homo sapiens
  modified_base (1)...(659): n = g, a, c or t
aattgaanttacactcactatagggcgaattgggcctctagatgcatgctcgagcggccgccagtgtgatggaatatctgcagaattcgcccttctctcggcatggacgagctgtacaaggaggaggccgcaaggccggtggcagcggtggctccaagtggtggccttgggggttcttgcggctgcagggagaccacaggcaggtgcccacctaagagggacagccacagaaaccctctaacctcagcactgcactccaccacgaacaccccacgcaggccctcaggcaacccggcaaccttccaaaccaacggaacaccccacacaggctgaggctggagccagaagccgccagaacatgggaccacagggccaggcaccacacaaacatggcgacggacacagccaatccaaacccccggaaaaaccgatttccncggngggggaaaaaccgccccagttttccaccccgggagagcgccccaaaagggggggggnacacccacccacncaccccaaaggggncgcaggggccaaacagcagaaanccccgaanttcccttgcggggggaattcgccgcgcccaaaggggaacnagcaaggaaggccattgccggttgccgggcccaagcaccgccaggaacagcgcgcaaggcgac

SEQ ID NO: 235 - DNA, 295 bp, Homo sapiens
ctgcagggagaccacaggcaggtgcccacctaagagggacagccacagaaaccctctaacctcagcactgcactccaccacgaccaccccacgcaggccctcagcaccgcactccaccacgaacaccccacacaggctgaggctggagccagaagctgccagaacatgggaccacagggccaggcaccacacaaacatggcgacggacacagccatccaacccgactcggacctccgccaggcccccagcgcacaaccatctgggatccccaggaaaagagctgcgtgcggccag

SEQ ID NO: 236 - DNA, 296 bp, Homo sapiens
gctggccgcacgcagctcttttcctggggatcccagatggttgtgcgctgggggcctggcggaggtccgagtcgggttggatggctgtgtccgtcgccatgtttgtgtggtgcctggccctgtggtcccatgttctggcagcttctggctccagcctcagcctgtgtggggtgttcgtggtggagtgcggtgctgagggcctgcgtggggtggtcgtggtggagtgcagtgctgaggttagagggtttctgtggctgtccctcttaggtgggcacctgcctgtggtctccctgcag

SEQ ID NO: 237 - DNA, 295 bp, Homo sapiens; identical to SEQ ID NO: 235

SEQ ID NO: 238 - DNA, 327 bp, Homo sapiens
  modified_base (1)...(327): n = g, a, c or t
ctggccgcacgcagctcttttcctggggatcccagatggttgtgcgctgggggcctggcggaggtccgagtcgggttggatggctgtgtccgtcgccatgtttgtgtggtgcctggccctgtggtcccatgttctggcagcttctggctccagcctcagcctgtgtggggtgttcgtggtggagtgcggtgctgagggcctgcgtggggtggtcgtggtggagtgcagtgctgaggttanagggtttctgtggctgtccctcttaggtgggcacctgcctgtggtctccctgcagccgcaaaacccancacactggagccaccgctg

SEQ ID NO: 239 - DNA, 295 bp, Homo sapiens
ctggccgcacgcagctcttttcctggggatcccagatggttgtgcgctgggggcctggcggaggtccgagtcgggttggatggctgtgtccgtcgccatgtttgtgtggtgcctggccctgtggtcccatgttctggcggcttctggctccagcctcagcctgtgtggggtgttcgtggtggagtgcggtgctgagggcctgcgtggggtggtcgtggtggagtgcagtgctgaggttagagggtttctgtggctgtccctcttaggtgggcacctgcctgtggtctccctgcag

SEQ ID NO: 240 - DNA, 554 bp, Homo sapiens
  modified_base (1)...(554): n = g, a, c or t
ctgcagggagacccgcaggcaggtgcccacctaagggggacagctacagaaaccctctaactcagcactgnactccaccacgacaccccacgcaggccctcagcaccgcactccaccacgaacaacccacacaggctgagtgctggagccagaagctggcagaacatgggaccacaggggccaggcaccacacaaacatggcgacggacacaggcatncaaaccgactcggacctccgccaggnccccagcgcacaaacatctgggatccccaggaaaagagctgcgtgcgggcagcgcagaaaccagcacagtggttagatatgattaagcgggcgngtcgantaatctgaggtctgatactcactgactgtcgtaagggngaattcgcgggcgcgtaaattcaattcggcctatagtgagtcgtattacaattcactgggcggcgttttacaacgtctgtgactgggaaaaacctgngcgttatccaacttaatctgngcttggagaatttcccttttgcagactgggcgtaataacgaaaaagggnccgaa

SEQ ID NO: 241 - DNA, 294 bp, Homo sapiens
ctgcagggagacacaggcaggtgcccacctaagagggacagccacagaaaccctctaacctcagcactgcactccaccacgaccaccccacgcaggccctcagcaccgcactccaccacgaacaccccacacaggctgaggctggagccagaagctgccagaacatgggaccacagggccaggcaccacacaaacatggcgacggacacagccatccaacccgactcggacctccgccaggcccccagcgcacaaccatctgggatccccaggaaaagagctgcgtgcggccag

SEQ ID NO: 242 - DNA, 293 bp, Homo sapiens
ctgcaggagaccgcaggcaggtgcccacctaagggggacagctacagaaaccctctaacctcagcactgcactccaccacgaacaccccacgcaggccctcagcaccgcactccaccacgaacaccccacacaggctgaggctggagccagaagctggcagaacatgggaccacaggggccaggcaccacacaaacatggcgacggacacagccatccaacccgactcggacctccgccaggcccccagcgcacaacatctgggatccccaggaaaagagctgcgtgcggcag

SEQ ID NO: 243 - DNA, 293 bp, Homo sapiens
ctgcaggagacacaggcaggtgcccacctaagagggacagccacagaaaccctctaacctcagcactgcactccaccacgaccaccccacgcaggccctcagcaccgcactccaccacgaacaccccacacaggctgaggctggagccagaagctgccagaacatgggaccacagggccaggcaccacacaaacatggcgacggacacagccatccaacccgactcggacctccgccaggcccccagcgcacaaccatctgggatccccaggaaaagagctgcgtgcggccag

SEQ ID NO: 244 - DNA, 400 bp, Homo sapiens
  modified_base (1)...(400): n = g, a, c or t
ccgcagtggagacacaggcaggtgcccacctaagagggacagccacagaaaccctctaacctcagcactgcactccaccacgacacccacgcaggccctcagaccgcactccaccacgaaaaacccacacaggcgtgaggctggagccagaagctgccagaacatgggancacagggncaggcgaccacacaaacatggcgacgtgacacaggcatccaaaccgacatcggactccgcagggccccagcgcacaaacatactgggatccccacggaaaagagctgcgtgctgggcagnagcgcnagaaaccagcacagctggttagagtacagataaanacgggcgcgtcgcacgtaaanctgaaaaaggtcgtgagtataatcaacatgtanactgntt

SEQ ID NO: 245 - DNA, 690 bp, Homo sapiens
  modified_base (1)...(690): n = g, a, c or t
ctgcaggggagaccacaggcaggtgcccacctaagagggacagccacagaaaccctctaacctcagcactgcactccaccacgancaccccacgcaggcccccagcaccgcactccaccacgaaacaccccaacacaggctgaggctggagccagaagctggccagaacatgggaccaacgngcgggnccccaacgcngggcgggcccagaacgaccgaaaagcgaaaccccaaaagaagnngcgcaaattatgcagaccaggaaaccagatgaaaacaaaccaaaggcgaccaaataccccaaaanancaccgcncaggaaagcatacacgcggggaaacgcccagttccaccacaggggccccacaaggaggggacccnccaccnacgngcaggggcaccggccagcagacagcgagagcgccgcgaagtaccgattaggaggcggcgaatacccgaccaccaaaaaagggggaaacacgaaagaaagctgggaaaacggcccgattttaggaccacgggagtttgaccgcacggggagacgcccccccaaagggacacccccagaggcacaaaaagcaagaagacacccccccccaaagagaccgctcaagacccgaaagaggttggagcggcttccttaacagaggaagcttaacncggcacagttnaaacgaagggcgagtgggc

SEQ ID NO: 246 - DNA, 205 bp, Homo sapiens
  modified_base (294): n = g, a, c or t
ctggccgcacgcagctcttttcctggggatcccagatggttgtgcgctgggggcctggtggaggtccgagtcgggttggatggctgatgtccgccgccatgatttgatagatggatgcctggaccctgatgagtcccaatgattctggcagacattctggacatccagcacatcagacctgatgatggggatgnttcgatggatg

SEQ ID NO: 247 - DNA, 358 bp, Homo sapiens
  modified_base (1)...(358): n = g, a, c or t
ctggccgcacgcagctcttttcctggggatcccagatggttgtgcgctgggggcctggcggaggtccgagtcgggttggatggctggtcgcgcagtggtggtgcctggcctgggcctgtctggcagcttctggctccagcctcagccctgtgtggggctggttccgntggtggagtgcgggtgctgaaggccatgcgatggagagtggatcnaggaaggagatgcagaagcatagagagttacgagggtatctagtggctgtaccctctataggtagggcaccatgacactagatggtactnccttgacagaacgcaagaaacaccaagaaaaacctgagaggccaaccagaaatgac

SEQ ID NO: 248 - DNA, 294 bp, Homo sapiens
ctgcaggagaccacaggcaggtgcccacctaagagggacagccacagaaaccctctaacctcagcactgcactccaccacgaccaccccacgcaggccctcagcaccgcactccaccacgaacaccccacacaggctgaggctggagccagaagctgccagaacatgggaccacagggccaggcaccacacaaacatggcgacggacacagccatccaacccgactcggacctccgccaggcccccagcgcacaaccatctgggatccccaggaaaagagctgcgtgcggccag

SEQ ID NO: 249 - DNA, 518 bp, Homo sapiens
  modified_base (1)...(518): n = g, a, c or t
actagttctagatcgcgagcggcgccctttttttttttttttttaaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggccctcataacctccatcttgcctcaggactatagtcctggaaccctnggggcggagaaaagcgccaacatttcatncctgcatacataagggagaaggagacaggacaacgataagtgaaagagaacagaacaagcaagaaaagaagcgganaacggccccagacaatagtaagggcgaangaatgggcagaagncttgcaancgtncccgggggcaatacaatcccttgaacacaaganccagggcannccgggaccacgcaagaaaaccaagaaacacat

SEQ ID NO: 250 - DNA, 592 bp, Homo sapiens
  modified_base (1)...(592): n = g, a, c or t
gcccgagccggactggtcaggatgatcaccggacgcgcagctcgccatcttcgccaacatgctgggcgtgtcgctcttcttgcttgtcgttctctatcactacgtggccgtcaacaatcccaagaagcagtgaatgaaagtggcgctttctccgggcccagggttccaggacatagtctgagtgcaagatggagggtatgagggggcttcacacttcacttcatccttttaaccattaaaatacaaagcgaactacanctggatttttccaaacaaattttatttcctcagagtcttccttaatcctatggaacaagaagctggcactgaatagtgggccagtataggggcttgcgttttctanatcccttcccccaatattaaaatatatgacttttaaaaaaaaaaaaaaaagggngccggtcgcgatctagaactagtccggagaaaccagacagttggttagatagataaagcggcgcgtcgactantctgaggtctgatactcactgactgtcgtaagggcgaattcgttttaaacctgcaggactagtccctttatgagggttaattctgagcttggcgtaatcat

SEQ ID NO: 251 - DNA, 439 bp, Homo sapiens
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacgttcacttcagtcccttctacccatcacaacatacaaggcaactacacctggatttttccaaacaacttttatttcctcagagtcttccttaatcctatggaacaagaagctgccactgaatagggcccagtataggggcttgcttttctactccctccccccaatataaaaatatagacttttaaaaaaaaaaaaaaaaaaagggcgccgctcgcgatctagaactagt

SEQ ID NO: 252 - DNA, 387 bp, Homo sapiens
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagac

SEQ ID NO: 253 - DNA, 208 bp, Homo sapiens
  modified_base (1)...(208): n = g, a, c or t
actagttctagatcgcgagcggcgccctttttttttttttttttaaaagtctatatttttatattggggggagggagtagaaaagcaagcccctatactgggccctattcagtggcagcttcttgttccataggattaaggaagactctgaggaaataaaagttgtttggaaaaatccaggtgtagttgcttntgntatgttgtgatg

SEQ ID NO: 254 - DNA, 473 bp, Homo sapiens
actagttctagatcgcgagcggcgcccttttttttttttaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtgatcatcctgaccagtccggctcggcccgcagaaaccagcacactggagccaccgctgccaccggcctt

SEQ ID NO: 255 - DNA, 470 bp, Homo sapiens
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttaaaaaaaaaaaaaaaagggcgccgctcgcgatctagaactagtccgcaaaacccagcacagtggttagatagataaagc

SEQ ID NO: 256 - DNA, 208 bp, Homo sapiens
actagttctagatcgcgagcggcgcccttttttttttttttttaaaagtctatatttttatattggggggagggagtagaaaagcaagcccctatactgggccctattcagtggcagcttcttgttccataggattaaggaagactctgaggaaataaaagttgtttggaaaaatccaggtgtagttgcatataagtatgttgtgata

SEQ ID NO: 257 - DNA, 435 bp, Homo sapiens
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttaaaaaaaaaaaaaaaaagggcgccgatcgcgatctagaactagt

SEQ ID NO: 258 - DNA, 393 bp, Homo sapiens
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaagggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatactagacttatt

SEQ ID NO: 259 - DNA, 367 bp, Homo sapiens
  modified_base (1)...(367): n = g, a, c or t
actagttctagatcgcgagcggcgcccttttttttttttttttttaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccttcataccctccatcttgcctcagactatgtacctggaaccctggggcngagaaagcgccacnttcattcctgcttctagggatcgnnagacggacacgatagntgactagagaacgacaagcaagaa

SEQ ID NO: 260 - DNA, 433 bp, Homo sapiens
gccgagccggactggtcaggatgatcacggacgtgcagctcgccatcttcgccaacatgctgggcgtgtcgctcttcttgcttgtcgttctctatcaccacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttcctaatcctcatggaacaagaagctgccactgaatagggcccagtataggggcttgcttttctactccctccccccaatataaaatatagacttttaaaaaaaaaaaaaaaagggcgccgctcgcgatctagaactagt

SEQ ID NO: 261 - DNA, 434 bp, Homo sapiens
  modified_base (1)...(434): n = g, a, c or t
actagttctagatcgcgagcggcgcccttttttttttttttttaaaagtctatatttttatattggggggagggagtagaaaagcaagcccctatactgggccctattcagtggcagcttcttgttccataggattaggaagactctgaggaaataaaagttgtttggaaaaatccaggtgtagttgctttgtatgttgtgatgggtagaagggatgaagtgaagtgtcaaggcccctcataccctccatcttgcctcagactatgtcctggaaccctggggcggagaaagcgccnctttcattcctgcttcttgggattgttgacggccacgtggtgatagagaacgacaagcaagaagagcganacgcccagcatgttggcgaagatggcgagctgcacgtccgtgatcatcctgaccagtccaggctcggc

SEQ ID NO: 262 - DNA, 434 bp, Homo sapiens
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttaaaaaaaaaaaaaaaagggcgccgctcgcgatctagaactagt

SEQ ID NO: 263 - DNA, 436 bp, Homo sapiens
actagttctagatcgcgagcggcgcccttttttttttttttttaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgaccagcaagaagagcgacacgcaccagcatgttggcgaagatggcgagctgcacgtccgtgatcatcctgaccaggtccggcatcgg

SEQ ID NO: 264 - DNA, 434 bp, Homo sapiens; identical to SEQ ID NO: 262

SEQ ID NO: 265 - DNA, 435 bp, Homo sapiens
gccgagccggactggtcaggatgatcacggacgtgcagctcgccatcgtcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttcttatttcctcagagtcttccttaatcctatggaacaagaagctgccactgaatagggcccagtataggggcttgcttttctactccctccccccaatataaaaatatagacttttaaaaaaaaaaaaaaaagggcgccgctcgcgatctagaactagt

SEQ ID NO: 266 - DNA, 437 bp, Homo sapiens
  modified_base (1)...(437): n = g, a, c or t
gccgagcggactggtcaggatgatcacggacgtgcagctcgccatcttcgccaacatgctgggcgtgtcgctcttcttgcttgtcgttctctatcactacgtggccgtcaacaatcccaagaagcaggaatgaaggtggcgctttctccgccccagggttccaggacatagtctgaggcaagatggagggtatgaggggccttcacacttcacttcatcccttctacccatcacaacatacaaagcaactacacctggatttttccaaacaacttttatttcctcagaggtcttcccttaatcctatggaacaagaagctgncactgaatagggcccagtataggggcttgcttttctactccctccccccaatatnaaaatatagacttttaaaaaaaaaaaaaaaaaagggcgccgctcgcgatctagaactagt

SEQ ID NO: 267 - DNA, 509 bp, Homo sapiens
  modified_base (1)...(509): n = g, a, c or t
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgncccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctggcactgaatagtggcccagtataggggcttgcttttctactccctccccccaatatnaaaatatagacttttaaaaaaaaaaaaaaagggggncggtcgcgatctagaactagtccgnnagaaaccagcacagtggttagatagataaagcgggcggtcgactantctgaggtctgatactcactgact

SEQ ID NO: 268 - DNA, 594 bp, Homo sapiens
  modified_base (1)...(594): n = g, a, c or t
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttaaaaaaaaaaaaaaaaaaagggcgccgctcgcgatctagaactagtccgnagaacccagcacagtggttagatagataaagcggccgctcgactagtctgaggtctgatactcactgactgtcgtaagggcgaattcgtttaaacctgcaggactagtccctttatgagggttaaattctgagcttggcgtaatcatggtcat

SEQ ID NO: 269 - DNA, 482 bp, Homo sapiens
  modified_base (1)...(482): n = g, a, c or t
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacactggatttttccaaacaacttttatttcctcagagtcttccttaatcctatggaacaagaagctgccactgaatagggcccagtataggggcttgcattttctactccctcccacccaatataaaaatatagactttttaaacaaacacaacaacacaacaaaaagggcgccagctcggcgatctagaactagtccggcaagaaccccagnaacaggggttagata

SEQ ID NO: 270 - DNA, 438 bp, Homo sapiens
  modified_base (1)...(438): n = g, a, c or t
gccgagccggactggtcaggatgatcacggacgcgcagctcgccatcttcgccaacatgctgggcgtgtcgctcttcttgcttgtcgttctctatcactacgtggccgtcaacaatcccaagaagcaggaatgaaagtggcgctttctccgccccaggggttccaggacatagtctgaggcaagatggagggtatgaggggccttcacacttcacttcatcccttctanccatcacaacatacaaagcaactacacctggatttttccaaacaacttttatttcctcagagtcttccttaatcctatggaacaagaagctggcactgaatagggcccagtatangggcttgcgttttctactccctccccccaatataaaaatatagacttttaaaaaaaaaaaatnaaagggngccgctcgcgatactagaactagt

SEQ ID NO: 271 - DNA, 439 bp, Homo sapiens
  modified_base (1)...(439): n = g, a, c or t
ctagttctagatcgcgagcggcgcccttttttttttttttttaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactgttcattcctgctntcttgggattgttcgacggncacgtagatgatagagaacgacaagcaagaagagcgaanacgcccagcatgtaaggcgaagatggcgagctgcacgtccgtgatcatcctgaccagtccggctcgga

SEQ ID NO: 272 - DNA, 742 bp, Homo sapiens
  modified_base (1)...(742): n = g, a, c or t
actagttctagatcgcgagcggcgcccttttttttttttttttaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagcgaacgacaagcaagaagagcgacacgcccagcatgttggcgacgatggcgagctgcacgtccgtgatcatcctgaccagtccggctcggcccgaagaacccagacaacactggagccaccgtgccaccggccttggcggctacctccttgtacaagctcggtccatgccgagagaagggcgaaatactgcagatatccatcacaactggcgggccgcatccgagcatgcatctagaagggccaaatacgccatataggngagtcggaataacaattcacctggccggcgatccaaacgtcgtgactggaaaaaacccgggggatnacccaaaaaagttaaaatcggccngaaggacanaaccccacgattaggcaaanagngcgaaaaataacnaaaa

SEQ ID NO: 273 - DNA, 437 bp, Homo sapiens
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaggtggcgctttctccgccccaggggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttaaaaaaaaaaaaaaaaaagggcgccgctcgcgatctagaactagt

SEQ ID NO: 274 - DNA, 412 bp, Homo sapiens
gccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttaaaaaaaaaaaaaaaaaaaaa

SEQ ID NO: 275 - DNA, 313 bp, Homo sapiens
caccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttggcccatggcatgtactctcacccagtttgtatctggtagcaaatactactttg

SEQ ID NO: 276 - DNA, 313 bp, Homo sapiens
cacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttg

SEQ ID NO: 277 - DNA, 314 bp, Homo sapiens
cacccagcaccttaccagaagctccacaaccacagcgtctgcccccagaagctgccagcacatctctgcctcagaagccacacttgaagttagcacgcgttcaggggtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactacgtttg

SEQ ID NO: 278 - DNA, 311 bp, Homo sapiens
caccagcaccttacagaagctccacaaccacagcgtctgcccccagaagctgccagcacatctctgcctcagaaaccacacttgaagttagcacgcgttcagagtcaaaactggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttg

SEQ ID NO: 279 - DNA, 313 bp, Homo sapiens
cacccagcacccttaccagaagctccacaaccacagcgtctgcccccagaagctgccagcacatctctgcctcagaaaccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttg

SEQ ID NO: 280 - DNA, 311 bp, Homo sapiens
caccagcaccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttg

SEQ ID NO: 281 - DNA, 312 bp, Homo sapiens
cacccagcaccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttg

SEQ ID NO: 282 - DNA, 312 bp, Homo sapiens
caccagcacccttaccagaagctccacaaccacagcgtctgcccccagaagctgccagcacatctctgcctcagaaaccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttg

SEQ ID NO: 283 - DNA, 311 bp, Homo sapiens; identical to SEQ ID NO: 280

SEQ ID NO: 284 - DNA, 262 bp, Homo sapiens
  modified_base (1)...(262): n = g, a, c or t
caccagcaccttaccagaagctccacaaccacaggcgtctggccccccaagaacaaacagggccctttgtggtcgtnccccacaaaagggggcccccttataaacacccataaaatttttcaccccttttntcccccttggggtgtcccccccccccttttttccccaaaaaaggggncccaaaaccaaaggggcccccccccctttaaaaaccctaaaaaccccccttttttttttttttngggggcccccaaacccaaac

SEQ ID NO: 285 - DNA, 312 bp, Homo sapiens; identical to SEQ ID NO: 281

SEQ ID NO: 286 - DNA, 2554 bp, Homo sapiens
atctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggggtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagct

SEQ ID NO: 287 - protein, 709 aa, Homo sapiens
MDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWGVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 288 - DNA, 412 bp, Homo sapiens
tcttgcggcagggtcaaaacaacatcatggtacaacttctggtaacatgtcagtgggcaacaaagtgtatgttttcatgtagttctattcacaattggttcctttgaatttatattacataataccacttgaaactggagtgagaagctggttacttgcttgcagtgcatcagaaccaaggtttctggggtggcccctgcagttcactccgcccaggagatcaaaaaggatgcgctctctacattcttaaatgccacagtcccctaccaacggcttagttgaagcacagctcccacatcagcacttattccctggcgcggccagcactgcctctacgaggccacacctgcctctgccaaggccactggccctcattcatcttcggggacgttctagagatatgcacttacag

SEQ ID NO: 289 - DNA, 406 bp, Homo sapiens
ctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctg

SEQ ID NO: 290 - DNA, 406 bp, Homo sapiens
caggggtcaaaacaacatcatggtacaacttctggtaacatgtcagtgggcaacaaagtgtatgttttcatgtaggttctattcacaatgtgctttgaatttatattacataatagccacttgaaactggagtgagaagctggttacttgcttgcagtgcatcagaaccaaggtttctggggtggcccctgcaggttcactccgcccaggagatcaaaaaggatgcgctctctacattcttaaatgccacagtcccctaccaacggcttaggtggaagcacagctcccacatcagcactgatgccctggcgcggccagcactgcctctacgaggccacacctgcctctgccaaggccactggccctcattcatctgcggggacgttctagagatatgcacttacag

SEQ ID NO: 291 - DNA, 406 bp, Homo sapiens; identical to SEQ ID NO: 290

SEQ ID NO: 292 - DNA, 406 bp, Homo sapiens; identical to SEQ ID NO: 289

SEQ ID NO: 293 - DNA, 406 bp, Homo sapiens; identical to SEQ ID NO: 289

SEQ ID NO: 294 - DNA, 406 bp, Homo sapiens; identical to SEQ ID NO: 290

SEQ ID NO: 295 - DNA, 406 bp, Homo sapiens
ctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattgtgtaatataaattcaaagcacattgtgaatagaacctacatgaaaacatacactttgttgcccactgacatgttaccagaagttgtaccatgatgttgttttgacccctg

SEQ ID NO: 296 - DNA, 406 bp, Homo sapiens
caggggtcaaaacaacatcatggtacaacttctggtaacatgtcagtgggcaacaaagtgtatgttttcatgtaggttctattcacaatgtgctttgaatttatattacacaatagccacttgaaactggagtgagaagctggttacttgcttgcagtgcatcagaaccaaggtttctggggtggcccctgcaggttcactccgcccaggagatcaaaaaggatgcgctctctacattcttaaatgccacagtcccctaccaacggcttaggtggaagcacagctcccacatcagcactgatgccctggcgcggccagcactgcctctacgaggccacacctgcctctgccaaggccactggccctcattcatctgcggggacgttctagagatatgcacttacag

SEQ ID NO: 297 - DNA, 5640 bp, Homo sapiens
agcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagtaatagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgctttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaatttaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaacgttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgttc

SEQ ID NO: 298 - protein, 738 aa, Homo sapiens
MTSDQDAKVVAEPQTQRVQEGKDSAHLMNGPISQTTSQTSSIPPLSQVPATKVSELNPNAEVWGAPVLHLEASSAADGVSAAWEEVAGHHADRGPQGSDANGDGDQGHENAALPDPQESDPADMNALALGPSEYDSLPENSETGGNESQPDSQEDPREVLKKTLEFCLSRENLASDMYLISQMDSDQYVPITTVANLDHIKKLSTDVDLIVEVLRSLPLVQVDEKGEKVRPNQNRCIVILREISESTPVEVIEALFKGDNLPKFINCEFAYNDNWFITFETEADAQQAYKYLREEVKTFQGKPIKARIKAKAIAINTFLPKNGFRPLDVSLYAQQRYATSFYFPPMYSPQQQFPLYSLITPQTWSATHSYLDPPLVTPFPNTGFINGFTSPAFKPAASPLTSLRQYPPRSRNPSKSHLRHAIPSAERGPGLLESPSIFNFTADRLINGVRSPQTRQAGQTRTRIQNPSAYAKREAGPGRVEPGSLESSPGLGRGRKNSFGYRKKREEKFTSSQTQSPTPPKPPSPSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 299 - DNA, 831 bp, Homo sapiens
  modified_base (1)...(831): n = g, a, c or t
actgcaggtggcagcacgggcgcgccgctcgggctcatctgacgcctctgcagcgggttccgcaggcctgcagggcggggaggccgggactgggcgtcagcgctgaangggcccagctgccagggggccagctgctggagaaccgcagctcgtccccggcggctcctaatcaccagcagctcctgtttctcaaacgcagacatccgccctcttggggtcaggcccttccacctgcagtgcgagccgcccagccactcccgactggcgctatgcctcgatcaccgctcttgctcccaagtggaccgcagggtgagacgctctcttacgtgggaccctgggtgtgcgctcactctctgaagggcctggaagctagattccagaggcgtgggccaactctccctgggtttttgggtgagccccctccgagggtgttcatttcctgagctctgtgtcatcttaagctctgagggtncgnagaaaccagacagtggttagatagataaagcgggcggtcgaataatctgaggtctgatactcactgactgtcgtaagggcgaattacggggcgntaaaattcnaattgcctatagtgagtctgtattacaaattcactggcgcggttttacaaangtcgtgactgggaaaaccctggcgttacccaacttaatcgcttgaggaatccccctttcgcagtggggtataggagaaggcgacgaatgcctccaacagtgggcagcnaagtacgacggtaagggtanacctataaagaaancggacgcggnggagcacgggaaaataccggagagagtgngacccctgccagacggattg

SEQ ID NO: 300 - DNA, 336 bp, Homo sapiens
accctcagagcctaagatgacacagagctcaggaaatgaacaccctcggagggggctccccaaaacccaggggagaggtggcccacgcctctggaatctagcttccaggccctttttcagagagtgagcgcccccaggggtccccgtaagagagcgtctcccctgcggtccacttgggagcaagagcggtgatcgaggcatagcgccagtcgggagtgggctggggcggctcgcctgcagggtggaagggcctgaccccaagaggggcggatgtctgcgttttgagaaacaggagctgctggtgattaggagccgccggggacgagctgcgggtct

SEQ ID NO: 301 - DNA, 281 bp, Homo sapiens
actgcaggtggcagccacggggcggccgcccccgggtcggctcatctgacgcctctgcagcgggttccgcagcctgcagggcggggaggccgggactggccgtcagcgctgaacggcccagcctgcccaggcccagctgctggagacccgcagctctgtccccggcggctcctaatcaccagcagctcctgtttctcaaacgcagacattcgcccctcttggggtcaggcccttccacctgcaggcgagccgcccagccactcccgactggcgctatgctc

SEQ ID NO: 302 - DNA, 580 bp, Homo sapiens
  modified_base (1)...(580): n = g, a, c or t
actgntagngtggcagcacgggcgcgccgctcggcctcatctgacgcctctgcagcgggttccgcagngcctgcagtgggcggggagtgccgggactggccgtcagcgctgaacgggcccagctggccaggggccagctgctggagacccgcagctcgtccccggcggntcctaatcaccagcagctcctgtttctcaaacgcagacattctggccctcttggggtcagtgcgccttccacctgcagtgcgagcctggcccagaccactcccgactggcgctatgcctcgatcaccggtcttgctcccaagtggaccgcagggtgagacgctctcttacggggaccctgggggcgctcactctctgaagtggcctggaagctatgattccagaggcgtgggccaactctccctgggttttggggagccccctccgagggtgttcattatcctgagctctggtgtcatcttaggctctgagggtcctgcagaaaccaggcaccagtggttagatagataaagctgggcggtcgacatagatctgaggtctgatactcactgactgtcgtaagggcgaattc

SEQ ID NO: 303 - DNA, 446 bp, Homo sapiens
  modified_base (1)...(446): n = g, a, c or t
actgcaggtggcagccacgggcgcgccgctcggcctcatctgacgcctctgcagcgggttccgcaggcctgcagggcggggaggccgggactggccgtcagcgctgaacgggcccagcctgcccagggcccagctgctggagacccgcagctcgtccccggcggctcctaatcaccagcagctcctgtttctcaaacgcagacatccgcccctcttggggtcaggcccttccacctgcagngcgagccgccccagcccactcccgactggcgctatgcctcgatcaccgctcttgctcccaagtggaccgcaggggagacgctctcttacggggaccctgggggcgctcactctctgaagggcctggaagctagattccagaggcgtgggccacctctccctgggttttggggagccccctccgagggtgttcatttcctgagctc

SEQ ID NO: 304 - DNA, 436 bp, Homo sapiens
  modified_base (1)...(436): n = g, a, c or t
cagtggttagatagataaagcggccgctcgactagtctgaggtctgatactcactgactgtcgtaagggcgaattcgcggccgctaaattcaattcgccctatagtgagtcgtattacaattcactggccgtcgttacaacgtcgtgactgggaaaaaccctggcgttacccaacttaatcgccttgcagcacatcccctttcgcagctggcgtaatagcgaagaggcccgaccgatcgcctcccaacagtgcgcagctatacgtacgggagtaagggtncacctatnaagaanagcgaccgccggtgggcgncaccacagggacaanaatggacgcacgancaacgaacgtcacccagaacagaanactagtcaaaaaanccgaaaaacngagagactaaggaaaanncaaaacaaaaacacaagaaaaccaacc

SEQ ID NO: 305 - DNA, 470 bp, Homo sapiens
actgcaggtggcagccacgggcgcgccgctcggcctcatctgacgcctctgcagcgggttccgcaggcctgcagggcggggaggccgggactggccgtcagcgctgaacggccccagcctgcccaggggcccagctgctggagacccgcagctcgtccccggcggctcctaatcaccagcagctcctgtttctcaaacgcagacatccgcccctcttggggtcaggcccttccacctgcaggcgagccgccccagcccactcccgactggcgctatgcctcgatcaccgctcttgctcccaagtggaccgcaggggagacgctctcttacggggaccctgggggcgctcactctctgaagggcctggaagctagattccagaggcgtgggccacctctccctgggttttggggagccccctccgagggtgttcatttcctgagctctgtgtcatcttaggctctgagggt

SEQ ID NO: 306 - DNA, 341 bp, Homo sapiens
  modified_base (1)...(341): n = g, a, c or t
actgcangtngnagccacgggcgcgccgcgtcgggctcatctgacgcctctttcagcggggttccgcagtgcctgcaggggcggggagtgccgggactgggcgtcagcgctgaaagggcccagctgtccagtgggccagctgctggagaaaccgcgaggngtctggttcccggcggggtccctaagtnaccagcagagngtcctggtttctcaaaacgcagacattctggccctcttgggggtcagggcctttcacctgcaggcgagcccgcgcccagnggccgacggtccccgaaacatggggcggcgtaattgtccttctcgaatctaaacagcggtcc

SEQ ID NO: 307 - DNA, 470 bp, Homo sapiens
actgcaggtggcagccacgggcgcgccgctcggcctcatctgacgcctctgcagcgggttccgcaggcctgcagggcggggaggccgggactggccgtcagcgctgaacggcccagcctgcccagggcccagctgctggagacccgcagctcgtccccggcggctcctaatcaccagcagctcctgtttctcaaaacgcagacatccgcccctcttggggtcaggcccttccaccctgcaggcgagccgccccagcccactcccgactggcgctatgcctcgatcaccgctcttgctcccaagtggaccgcaggggagacgctctcttacggggaccctgggggcgctcactctctgaagggcctggaagctagattccagaggcgtgggccacctctccctgggttttggggagccccctccgagggtgttcatttcctgagctctgtgtcatcttaggctctgagggt

SEQ ID NO: 308 - DNA, 3981 bp, Homo sapiens
gtggtgagaggggaagggacatttacagcccttttctccctcccttgcccacaactactgtgccccagcatggcacccgggtcagcccctgccagctctggagctgtcatcatctctccctcttatgcctcttcagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggtaaggagacctccatctctgcctgggaaggctggaggccaagtcccaggagccccatgagctgaggggcctggggctgagcccctcctccacccccaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgagtggcaggtgcccagctcatgtgagtctgcatttgtgtgggcacagttacgcacacacacctttcctccttcctcatgtgggtccccaagagaacagcttcttcttgagacgagaaacctcatgggaggaaccacagcttcaacttcttttgttccagccacctctctcccgagtcaagtaaccctaacagccccccgaccttagacactttcacgctcattattgcactggcaagtgcgctggcctgagagagtcgagagcacatactctgggatcagaaagttttagtttgaaacacatctttgttgtcaaccagctttgtgatcatgggctggtctcttaacctctctgagcctcgttacctaaactttaaaatgagaacatatcttcgggttgttgtaagaattaaaagcactttaagacagtatttagcagatagcaggggctgaaacaatggcagttattgctgttataatatgatgtaataattatacaatggtaaaaattattattattattattaccggtgattgtgaagtgaaataaaagggagggtggtagagcaacttcctctatcttgaagttctaagaggggaagcatggagtctgcatgtatgcaaatcccagccacctgaagggggaaggtgcctttccccacttgtggtcctttgctcaaatgtgtgtggttcctgctggagggccttggtgggagatctgctttgtcccacctctgcctacctggctgtagctggttgccaggtggctccaagagcaatgtcaaaggccagcatgaataaggagccaaagttttgggttcacacccctgctctgccaggaggaagactggtatgcaatggccagttcccctgactgagccccagggaacctcaaggaatggcccctacagtaaaatcttaaacaaagaacaggggcttaaccaacaatcctgctgcaacatgcattccagtgacacacagagctgaactcagtgggagcccgtcctacggcctgaggtcagggctgctctcttctggcccatgccttttttttttttttaatctatttattttgaaacagagtctcactctgtccccaggctggagtgcaatggtacagtccggctcactgcagtctcagctacccaggctcaagggatcctcccacctcagcctccccagtagctaggactacaggcatgtgccaccacacccggctgatttattgtattttttgtagagagggagttttgccatgttgcccaggctggtctcaaactcctggactcaagcgatccacccacctcggcctctcagagtgctgggactacaggcatgagccacccacccggcccagcctcacacctgtctttagtggcttagcccgcccacctgccctctgcccttccataggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggtgagtggaggcctgaggaagctggcaggccttggcgagtcacactgggacggagagggcgcaggggacacagccatgggcccaagtcggggtcagaaaaactgccctgttgcttgcagttccttctgcccacctccaccctgggccgcccagccaatgatcgctttctgtgaaattgctgacttccgcatccctctcctccttccctgcctcacttctcccgtagcaccctccacttcctaatctacgtcagtactggttaatgttgcctgtccatcctttccacgctcctcccccgagaatgtcagccccttgaagctgcggtctgtctatgctggtcgtaccctcagagcctaagatgacacagagctcaggaaatgaacaccctcggagggggctccccaaaacccagggagaggtggcccacgcctctggaatctagcttccaggcccttcagagagtgagcgcccccagggtccccgtaagagagcgtctcccctgcggtccacttgggagcaagagcggtgatcgaggcacagcgccagtcgggagtgggctggggcggctcgcctgcaggtggaagggcctgaccccaagaggggcggatgtctgcgtttgagaaacaggagctgctggtgattaggagccgccggggacgagctgcgggtctccagcagctgggccctgggcaggctggggccgctcagcgctgacggccagtcccggcctccccgccctgcaggcctgcggaacccgctgcagaggcgtcggatgaggccgagcggcgcgcccgtggctgccacctgcagtaccagcgggccggtgtgcgcttcctcgcccccttcgcggcccacccgctggacggcggccgc

SEQ ID NO: 309 - protein, 435 aa, Homo sapiens
VVRGEGTFTALFSLPCPQLLCPSMAPGSAPASSGAVIISPSYASSVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSPLELSEFLWVDFVVENSTGGGVAVTRPVTWQLEYPGQAPEAEKDKMVWEILVSERDIRALIPLAKVRRPPSLPGKAGGQVPGAP

SEQ ID NO: 310 - DNA, 135 bp, Homo sapiens
ctggacggcctggctgggctgaagggcgaggacagccgcagcaaggaggcaggggagggcggcctaccgctgtgcgggcccacggacaagaccccactgctgagcggcaaggccgccaaggcccgggaccgcgag

SEQ ID NO: 311 - DNA, 458 bp, Homo sapiens
  modified_base (1)...(458): n = g, a, c or t
ctgcccatggcgtgcgagttggtcagtctggtggcagcggacgacacgtgcaccatggcctgcggcggccggcacagagctgaacagcgactgcagcacggaggagccggccacggagccgaggttggcctgcagggacatggggccgagcgcgaactgcggtcccggcgggaaggggcccaggaaggaccggtgcgtctgggcggaggacgccgcgccgcctgcggaggacgccgccggggccaggccggggccgctgaggaggcttccgggaggcacggccgccgcagagatgaagaggttgtggccattcttgaggtcgacctcgcggtcccgggccttggcggccttgccgctcagcagtggggtcttgtccgtgggcccgcacagnggtaggccgcctcccctgcctccttgctgcggctgtcctcgcccttcagcccagccaggccgtccag

SEQ ID NO: 312 - DNA, 322 bp, Homo sapiens
ctgcccatggcgtgcgagttggtcagtctggtggcagcggacgacacgtgcaccaggcctgcggggcggcacagagctgaacagcgactgcagcacggaggagccggccacggagccgaggttggcctgcaggggacatggggccgagcgcgaactgcggtcccggcgggaaggggcccaggaaggaccggtgcgtctgggcggaggacgccgcgccgcctgcggaggacgccgccggggccaggccggggccgctgaggaggcttccgggaggcacggcgccgcagagatgaagaggttgtggccattcttgaggtcgact

SEQ ID NO: 313 - DNA, 419 bp, Homo sapiens
ctggacggcctggctgggctgaagggcgaggacagccgcagcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtc

SEQ ID NO: 314 - DNA, 458 bp, Homo sapiens
  modified_base (1)...(458): n = g, a, c or t
ctggacggcctggctgggctgaagggcgaggacagccgcagcaaggaggcaggggagggcggctaccgctgtgcgggcccacggacaagaccccactgctgagcggcaaggccgccaaggcccgggaccgcgaggtcgacctcaagaatggncacaacctcttcatctctgcggcggcgtgcctcccggaagcctcctcagcggcccggcctggccccggcggcgtcctccgcaggcggcgcggcgtcctccgcccagacgcaccggtccttcctgggccccttcccgccgggaccgcagttcgcgctcggcccatgtccctgcaggccaacctcggctccgtggccggctcctccgtgctgcagtcgctgttcaagctctgtgcctggcctgccgcaggcctggtgcacgtgtcgtccgctgccanacagactgaccaactcgcacgccatgggcag

SEQ ID NO: 315 - DNA, 458 bp, Homo sapiens
  modified_base (1)...(458): n = g, a, c or t
ctggacggctggctgggctgaagggcgaggacagcgcagcaaggaggcaggggagggcggctaccgctgtgcgggcccacgggacaagaccccactgctgagcggcaaggccgcaaggcccgggaccgcgaggtctgacctcaagaatgggcacaactcttcatctctgcggcggnctgtgcctcccggaagcctcctcagcggcccggcctggccccggctggctgtcctccgcagtgctggctgcggcgtcctccgcccagacgcaccggtccttcctgggccccttcccgccgggaccgcagttcgcgctcggcccatgtccctgcaggccaactcggctccgtggccggctcctccgtgctgcagtcgctgttcagctctgtgccggccgccgcaggcctggtgcacgtgtcgtccgctgccaccagactgaccaactcgcacgccatgggcag

SEQ ID NO: 316 - DNA, 455 bp, Homo sapiens
ctggacggcctggctgggctgaagggcgaggacagccgcagcaaggaggcagggggagggcggctaccgctgtgcgggcccacggacaagaccccactgctgagcggcaaggccgccaaggcccgggaccgcgaggtcgacctcaagaatgggcacaactcttcatctctgcggcggccgtgcctcccggaagcctcctcagcggcccggcctggccccggcggcgtcctccgcaggcggcgcggcgtcctccgcccagacgcaccggtccttcctgggccccttcccgccgggaccgcagttcgcgctcggcccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcag

SEQ ID NO: 317 - DNA, 457 bp, Homo sapiens
ctggacggcctggctgggctgaagggcgaggacagccgcagcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggcccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcag

SEQ ID NO: 318 - DNA, 6579 bp, Homo sapiens
gcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggccacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaactgcactggatgccctgcacgctcagaccgtgtctcagacggcggcctcctcaccccaggatgcctacagatcccctcacagcccgttctaccagctacctccgagcgtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccacctaacgccgccttgcctcctcccccaacgctgctggcctctaaccctgagcccgcgcttctgcagagcctcgcgtccctcccgcctaaccaagctttcttgccccccacctctgctgcctctctgccgcctgctaacgcctctttgtctatcaagctcacctccctcccgcacaagggcgcccgcccctccttcacggtgcaccaccagcccctgccccggctggccctggcccaggccgcgcccgggatcccacaggccagcgccacggggccgtccgcggtgtgggtgtccctcggcatgccgcctccctatgccgcgcacctttcgggggttaagccgcgataaagaccttgcttagctagcagtgcgtattgtgtaaggtaaggccagagccctgcgcggtggctcactccagacactgaactgtccttcctttggcagagaagacggccacagggctcggcagaagttccgggggtcctgaggagggaagagggagagagccagggagaccagggagatggtcgcgagaggagggactacaggacgggcaccagccatggagtggcctgagtgtgttgggttccagctgcccgcagctgggttcctgcggtgacgccgcaggactgaggccagccctgggggcagctgtgccagcccctgtgggcgaggctcacggggtgccaggccagggggctgggagctctagctcctagagcagtctccagggctccatccgcaccaggcccaggtcactcatgacgggtggcgtggcttggtgctgttccccaggcgcccagcatgtagcaggcacggtgccggctgcagaggtcctggagagccagggtggctggctggatgcctctggtcggggctgtctggccagtagcctcggatgccctcatagggagccagtgaagccccaagtgccctgcctgcctgggggctgatgggttcccggcggggtcgagaggcaagctctgtgccctgcgtgttgaggcccccttgctggacacggctgatggccacactgccctgtggtcatggcccacagccgaggggctttcagctgctcagatgtcagcaccaagctgggcaggttagtgtagacggtgcccacctttgagaccagaaggaagttggaagcaggagtgattttgatgatgtgaggccttcagggaatgtcctgttcactcctcccccaagaggctgtggagactgtggccgctgacccctgagggcagttggccacccgtgccctccagggacatggcgtgcctggcggcgtagtgcaaaggtgccctctgcttgcccctggccttctgcctcaggggcccctgggacacaggccttcctgggcgagtccaaagcccaccgggcaaggagaggaggactgggagccaggagccaaggcggaggctgtggccagggctggtcagcctggcgggtcaatgcgggcacctgcgggctggacaagctatgctgggtctcttaggagatgagctgcaggtagggtggctttagctggactcggctgtgtgtctcctttggaggaaggctggagcttggccggcgtgtccaggtgtcaggctccctggtctgtcacggggcacgcccgtcgtctgttgtggttagaggagctggcactatgcctgtcatggtgctggccccaggtggcgtgtgtgctcgtgggaggcctcggtccccagcctgggtgagtgttgggctcccccaggcgcgatggtaacctcaggccgctcttcccgctgtgcccttctgcaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcatttttt

SEQ ID NO: 319 - protein, 1592 aa, Homo sapiens
MIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAATPTKGPEGKVAGPADAPMDSGAEEEKAGAATVKKPSPSKARKKKLNKKGRKMAGRKRGRPKKMNTANPERKPKKNQTALDALHAQTVSQTAASSPQDAYRSPHSPFYQLPPSVQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGVFNHAVPSASAHPFGARVGRGAACGSATLGPSPLQAAASASASSFQAPASVETRPPPPPPPPPPPLPPPAHLGRSPAGPPVLHAPPPPNAALPPPPTLLASNPEPALLQSLASLPPNQAFLPPTSAASLPPANASLSIKLTSLPHKGARPSFTVHHQPLPRLALAQAAPGIPQASATGPSAVWVSLGMPPPYAAHLSGVKPR

SEQ ID NO: 320 - DNA, 475 bp, Homo sapiens
ggaataaaagagtggaaatggggatttccaggtgctcccctggttcatctaggcaccagagagctgcactagcaggtctatcatgaatctccttggaatgctcatttttagtcctacttgatgtgtctgtttctggaaatgcagtatttttaatgtatctcaacaaaatattttatgattagtaagcttattcttatataaaggacaatttttttcctttttcacaggttctaataattttttatttaataattagatctattagattttattcataactgtggtagttgaagtaccttctaagctgagttcagatttgagaataaaccttggggtatcattacagaaaattttgtctcaatctgctttgtatttgaaagatatgagattcttgaattatatatcttacagactagtccccaaaagaatacgtgtttccttacctttaatttctcatggtagttagtctgtgaat

SEQ ID NO: 321 - DNA, 545 bp, Homo sapiens
cgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattg

SEQ ID NO: 322 - DNA, 423 bp, Homo sapiens
cgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgc

SEQ ID NO: 323 - DNA, 814 bp, Homo sapiens
cgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgg

SEQ ID NO: 324 - DNA, 6807 bp, Homo sapiens
agccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatagacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtagacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtcttggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacaggtttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatgg

SEQ ID NO: 325 - protein, 1479 aa, Homo sapiens
MAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 326 - DNA, 780 bp, Homo sapiens
  modified_base (1)...(780): n = g, a, c or t
ggcttgtaccttgccacggtggcagatgacagactcctcaggatctgggccctggaactgaaaactcccagttgcatattgcatcctatnaccaatgggctttgctgcacattttttccacatggtggagtcattgccacagggacaagagatggccacntccagttctggacagctcctagggtcctgtcctcactgaaggcacttatgccggaaagcccttcgaagtttcctaacaacttaccaagtcctagcactgcctatccccaagaaaatgaaagagttcctcacatacaggacttttgttaagcaacaccagcatcttgtgcttctttggtgagcaggtaaatcgtcctgtcaagggagttgctggaataatgggccaaacatctggtcttgcattgaaatagcactttctttgggattgtgaatagaatgtagcaaaaccagattccagtgtactagtcatggatctttctctccctggcatgtgaaagtcagcttagaggaagagatccacttgcaccggcacagagccgcggagaaccagcgacactgggagcacggtggcaacggccctggcggctctcctgtacagctcgtcangccgagagaaggccaaaatncgggaaacctgatggaatcgcccttagtgagggtatccagaactggcaacatgccanaaacggtaccgggtaaactgttcccccccatccccaaaaaaccnacaaaggaccggcccncacataacaacacacaaaagcgcacanccatcacaga

SEQ ID NO: 327 - DNA, 333 bp, Homo sapiens
ggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggacttttttaagcaacaccacatcttgtgcttctttgtag

SEQ ID NO: 328 - DNA, 781 bp, Homo sapiens
  modified_base (1)...(781): n = g, a, c or t
cggntctgttgccgtgcaagtggaatcatcttacctctaagacatgactttcacatgccaggggagagaaagatccatgactagtacactggcaatctggttttgctacattctattcacaatcccnaagaaatgctatttcaatgcaagaccagatgtttggcccattattccagcaactccctttgacaggacgatttaccctgctacaacagaagcacacagatgtggtgttgcttaaaaaagtcctgtactgtgaggaactctttcacttttcttggggattggccacgtgctatggacttaggtaagttgttcaggaaacttcgcaagggctttccggcataagtgctatcagtgaggacaggaccctagtgagctgtccagaactggacgtggccatctcttgtccctgtggccaatgactccaccatgtggaatacatgtncagcaaagcccattggtcataagaacaaaatgcaatcgggagttnccaggtccaggggcccgagatcctgagggaggtcntgtgcaatctgccagcgtggcaagggtaccaagcccccganaaaaccccagagcaacaaggtgggtctcagaatnagaatcaagcgggccggtccganactagccttcgcaggggtcctgaaatactcaccaaagggncggcaaataagggggggcacattcgtttcaaaacctcgcccgaaaaagacncctaggatgaanggctacaaatgaccagcgtgagaaacactggccncgcagaccccggggtgac

SEQ ID NO: 329 - DNA, 544 bp, Homo sapiens
cggctctgttgccgtgcaagtggaatcatcttacctctaagacatgactttcacatgccaggggagagaaagatccatgactagtacactggcaatctggttttgctacattctattcacaatcccaaagaaatgctatttcaatgcaagaccagatgtttggcccattattccagcaactccctttgacaggacgatttaccctgctaccaaagaagcacaagatgtggtgttgcttaaaaaagtcctgtatgtgaggaactctttcattttcttggggattggcagtgctaggacttggtaagttgttaggaaacttcgaagggctttccggcataagtgcttcagtgaggacaggaccctaggagctgtccagaactggacgtggccatctcttgtccctgtggcaatgactccaccatgtggaaaaaatgtgcagcaaagcccattggtcataggagcaaatgcaatgggagttttcagttccagggcccagatcctgaggagtctgtcatctgccaccgtggcaaggtacaagcccccg

SEQ ID NO: 330 - DNA, 2610 bp, Homo sapiens
cggacgcgtggggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggcttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaaaaaaaaaaaaaaaaaaaaaaaaaaaaaaaaaaaaaaaaaaaaaaaa

SEQ ID NO: 331 - protein, 404 aa, Homo sapiens
MEAGEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 332 - DNA, 257 bp, Homo sapiens
  modified_base (1)...(257): n = g, a, c or t
cgtctgcctgccactggtgcgggcgcgacgcctcgggcacgtaggctggcttcctccgccgcagggctcttgnccggtaaaaccttgttcatggtgcccgcacccgtctggctccgtcctgcagggtttcctggggggccccggggcccccacaagggggactggggggcagggtgccggttcaagggccccccttcctttgttacaggcttcggtccaatgcngagaaggaaaggggcgaaattcnctgcagaata

SEQ ID NO: 333 - DNA, 821 bp, Homo sapiens
  modified_base (1)...(821): n = g, a, c or t
cgtctgcctgccactggtgcgggcgcgacgcctcgggcacgtaggctggcttcctccgccgcaggctctgccgtaacttgttcatggttgcccgccccgtctggctccgtcctgcaggtttctggaggccaccgttgccatcgggcctatgggcgggccttccttccctttgttaccaggccttccggttccccaatagcccgggaaggaagaaaacgggggcggaaatttccttggccaggagttattcccnatttcaaacaaacttgggccgggggacccggagtttccggaaagcncatatttgncaaatttcataaggagaagggggggggcccccacaaaatttttcggcagccccctttaatttanggtttgagaaaggatttccgggtaatttttacaccaaaatttttcaactttgtggggcgcccaggatacagaggatatttaaaacacaaaaaacggcggggtancaggggtntggggncctttgggggggagagaagaaaaacccgcccccctttttgtgggccgnggnttttataacgccccccccganaaaatccttttataaaatttccatgcgagccgcccgttttttttnggngtgagagagggacaggagcacaaatatttttcccccccgccctntttatttttttaccgagggcgccccaaanaggcgttattggggacgcggccggtttacaaaataataatgacgctgcgagaaaaaatagagaaaagggtggccccccccctgcggagaanaaccccgcggnggnagatattacttggcagggagcgcccctttttat

SEQ ID NO: 334 - DNA, 502 bp, Homo sapiens
  modified_base (1)...(502): n = g, a, c or t
cgtctgcctgccactggtgcgggcgcgacgcctcgggcacgtaggctggcttcctccgccgcaggctctgccgtaacttgttcatggtgcccgcccccgtctggctccgtcctgcaggttttctgggggccccggggcccccaacaagggggggccttgggggggccagggttgccggagaagcccaaggcaacacttggngaaagcccaaccggntaggcacaaccggggccacttatnggcganggagccatnacacattcccttttggttacccaagggcanatccggatccccaatttgcacccgganatggaaagcaaaagggggcgccggaaaaaatttcctttgcccgaggattaatttccccaaattccaaacacaccctgtggtggcacgggngaccacggaattccgaaaaggccnattttggcccatattcttttagggaaagggggggccccccccaaaagaattttgttccnggccccccatatataaa

SEQ ID NO: 335 - DNA, 657 bp, Homo sapiens
  modified_base (1)...(657): n = g, a, c or t
cgtctgcctgccactggtgcgtggcgcgacgcctcgggcacgtaggctggcttcctccgccgcaggctctgccgttaaacttgttcattggtgcccgccccgttcttggcctccgtcccttgcaggtttctgggggccccggnggggcccccaaacaagggggtggctttggaagccccaaccgggttgccaacncggacactatggggggacctttcacattccttttgttaccaggcttcggttcacaattggcccgaaggaaagaaaagggggcgcggaaatttccttgtgccaaggattttattccccaattttcaagcgaccgttgggccggggaccccggactccgaagccatttggcaattctatnagggaaaggggngcccccaaaatttcgcggaccctataaataagattgagcagactcgggtaatttataacaaattttaccacaacgcgttgttggggacccccgggtatactgcaggttatttattataaccanaaaaggcggtgatattccangtagttgtggaaaacctgttgtggnggggaaacaaaaaaaaacaacacccccccccttttttggggtanggccgggtgatttttataacaacccccccagccaaaaagaagccgctttttntaanaaag

SEQ ID NO: 336 - DNA, 169 bp, Homo sapiens
cgaggaggctcgcgcgcgtgcatcccgcaccatcccccagcccccagaaacctgcaggacggagccagacggggtgggcaccatgaacaagttacggcagagcctgcggcggaggaagccagcctacgtgcccgagggccgtcgcgcccgaaccagtggcaggcagacg

SEQ ID NO: 337 - DNA, 169 bp, Homo sapiens
cgtctgcctgccactggtgcgggcgcgacgcctcgggcacgtaggctggcttcctccgccgcaggctctgccggtaacttgttcatggtgcccaccccgtctggctccgtcctgcaggtttctgggggctgggggatggtgcgggatgcaacgcgcgcgagcttcctcg

SEQ ID NO: 338 - DNA, 160 bp, Homo sapiens
cgtctgcctgccactggtgcgggcgcgacgcctcgggcacgtaggctggcttcctccgccgcaggctctgccgtaacttgttcatggtgcccgccccgtctggctccgtcctgcaggtttctgggggatggtgcgggatgcacgcgcgcgagcctcctcg

SEQ ID NO: 339 - DNA, 159 bp, Homo sapiens
  modified_base (1)...(159): n = g, a, c or t
cgaggaggctcgcgcgcgtgcatcccgnaccatcccccagaaacctgcaggacggagccagacggggcgggcaccatgaacaagttacggcagagcctgcggcggaggaagccagcctacgtgcccgaggcgtcgcgcccgaccagtggcaggcagacg

SEQ ID NO: 340 - DNA, 1830 bp, Homo sapiens
atgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggtgacctgcaaaagacattcgagattgaactgtag

SEQ ID NO: 341 - protein, 609 aa, Homo sapiens
MSRSAAASGGPRRPERHLPPAPCGAPGPPETCRTEPDGAGTMNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 342 - DNA, 290 bp, Homo sapiens
cgcgggatgtcgtactcgtcctgctccggctgggcggcctcgtatacatagccctgccccacgcgggtgggcaccaccacctttgccgggggcttcgtgccctcccagctgcgtgtgtccatggacggggggacctggtagatgtcatgccccatcccggcagaaggtggcacctggtaaatatcctgggcagggcctccaggccctgggggcacctggtacaggtctgtggccgggctgggaaacgggtgatggggtgtctgcttcgagaaggtggatgtctgcttggc

SEQ ID NO: 343 - DNA, 291 bp, Homo sapiens
gccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgatccatggacacacgcagctgggagggcacgaagcccccggcaaaggtggtggtgcccacccgcgtggggcagggctatgtatacgaggccgcccagccggagcaggacgagtacgacatcccgcg

SEQ ID NO: 344 - DNA, 291 bp, Homo sapiens
  modified_base (1)...(291): n = g, a, c or t
cgcgggatgtcgtactcgtcctgctccggctgggcggcctcgntatacatagccctgccccacgcgggtgggcaccaccacctttgccgggggcttcgtgccctcccagctgcgtgtgtccatggacggggggacctggtagatgtcatgccccatcccggcagaaggtggcacctggtaaatatcctgggcagggcctccaggccctgggggcacctggtacaggtctgtggccgggctgggaaacgggtgatggggtgtctgcttcgagaaggtggatgtctgcttggc

SEQ ID NO: 345 - DNA, 291 bp, Homo sapiens
gccaagcagacatccaccttctcgaagcagacaccccatcacccgtttcccagcccggccacagacctgtaccaggtgcccccaggggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcg

SEQ ID NO: 346 - DNA, 290 bp, Homo sapiens; identical to SEQ ID NO: 342

SEQ ID NO: 347 - DNA, 292 bp, Homo sapiens
gccaagcagacatccaccttctcgaagcagacaccccatcacccgtttcccagcccggccacagacctgtaccaggtgcccccagggacctggaggccctgcccaggatatttaccaggtgccaccttctgccgggatggggcatgacatctaccaggtccccccgatccatggacacacgcagctgggagggcacgaagcccccggcaaaggtggtggtgcccacccgcgtggggcagggctatgtatacgaggccgcccagccggagcaggacgagtacgacatcccgcg

SEQ ID NO: 348 - DNA, 290 bp, Homo sapiens; identical to SEQ ID NO: 342

SEQ ID NO: 349 - DNA, 292 bp, Homo sapiens
  modified_base (1)...(292): n = g, a, c or t
gccaagcagacatccaccttctcgaagcagacaccccatcacccgtttcccagcccggccacagacctgtaccaggtgcccccagggncctggaggccctgcccaggatatttaccaggtgccaccttctgccgggatggggcatgacatctaccaggtccccccgatccatggacacacgcagctgggagggcacgaagcccccggcaaaggtggtggtgcccacccgcgtggggcagggctatgtatacgaggccgcccagccggagcaggacgagtacgacatcccgcg

SEQ ID NO: 350 - DNA, 289 bp, Homo sapiens
gcgggatgtcgtactcgtcctgctccggctgggcggcctcgtatacatagccctgccccacgcgggtgggcaccaccacctttgccgggggcttcgtgccctcccagctgcgtgtgtccatggacggggggacctggtagatgtcatgccccatcccggcagaaggtggcacctggtaaatatcctgggcagggcctccaggccctgggggcacctggtacaggtctgtggccgggctgggaaacgggtgatggggtgtctgcttcgagaaggtggatgtctgcttggc

SEQ ID NO: 351 - DNA, 3208 bp, Homo sapiens
gaggcggcagctgcgcggcggcaccggggcggctgcggcgcgctcggagccccgaggcacgcggcccgggcagctcggtgtgcgcccccgcgagagccgggccccaggcccgccggacaccatgaaccacctgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggctccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcaccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccgcagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaa

SEQ ID NO: 352 - protein, 870 aa, Homo sapiens
MNHLNVLAKALYDNVAESPDELSFRKGDIMTVLEQDTQGLDGWWLCSLHGRQGIVPGNRLKILVGMYDKKPAGPGSGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 353 - DNA, 1050 bp, Homo sapiens
  modified_base (1)...(1050): n = g, a, c or t
accgctcctctcccgagggcacacaaccaaccaaactggtgctctgaaacagcgccagtgtccagttctctgaggagcactgggtccatgaggtcttggncgggcggtgcagctgcgctggagctgctggagtgtgcgtggaaganactgtngagtggcgtggntcattcaagaacnggtgttccggangaaaaccagaacaaggtgggttagatanggaataaaaggggggccggatcgaataaatcttgaagggtcttgaantnaatcgtnccaaactttggaacacttggtcccgggttttcaacagtggtgggcgaacatttttcatctagcagtgggacccggcggttaaataatttctataaatatactgggccngtaataaatagattggaagngttcacgagtaatttttaacacaacatttccaaccatttgtgggngccgagcgaccgagagtaatanttaagaaaaacgggttaccgttggaaaccccgtttggtgggtggaanagtaaaaacaagacccatttatgaggacgcgggtntatntaaccagccccaaagaanacaggtttaaaaaagtttcatggcgacccagctttnttggtcgaagttntgaagacaaagaattttttgnggaccgngcattaatttattaattgaggacggaaaaagaggatttgtgtncggacacaggcgttaaaaaattaaattaccgcgnataaaagatgaaaatagttggtgcgccgaggncgaaaacgctcggaaagtattctcnggcagcgccngttttttatacccgcaaaaaacgaaagagtagataattgtgctagccggtcgtcaantagatgacgaactaaaatatnataantatggggtttaacacgtgtgggtgagtaagagaggaatttaaaaaacagggtgtggtttatacataaaccattatatttttataatagcgaatganaggtaaaagagacccggcnggagataatatctagtgggtaccagattggtgaataataggtactggggtaaatttgtt

SEQ ID NO: 354 - DNA, 698 bp, Homo sapiens
  modified_base (1)...(698): n = g, a, c or t
accgctcctctcccgagggcacacacccacccaaactggtgctctgaaccagcgccaggtccagttctctgaggagcactgggtccatgagtctggncggccggtgcagcgcgcggagctgctgcaggtgctgcagagcctggagtggcgtgctcatccagaactgtgttctgcgagaaaccagcacagtggttagatatgataaagcgggcgctctgactaaatctgaggtcttgatactcactgactgtcgtaagggnggaattctgcggccgcgtaaattcaaattctgccctatangtgagtccgtattacaattcacttggggcgtcgttttacaacagtctgtgactgggaaaaaacctggcgttacccacacattaatctgccttgcagcgacattcccctttctgccagactggncgtaatagcgaagaggggccgcgacacgatctgcccttcccaacagttgcgcagagctatacggtacagggggangatgttaaagcggntgttacaaacgtatntaaaagaggtaaagaaaagaaccgcagggtgtgtaaaatncacggaggcncttanggtgtattggtgcgcggcgatttgtttncccaacggcaagnttgggaatacaatttaaattattgaaacaaagngtgaccncgatgtgtggtgtggaanagggaatataggggtgt

SEQ ID NO: 355 - DNA, 168 bp, Homo sapiens
accgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgt

SEQ ID NO: 356 - DNA, 406 bp, Homo sapiens
ctggtggggatggggaccgcctgcccaggggtgagctgccttttgctccacagccgacactaaagacaattcccaatcctgagtgggtggcagagactcctgcgatgcccgtctcaggtagctgtggggcaccagcccacaagccgaggttggctctcctaggagtgagaactgcccaagggctgcagaaacaggccacccagctctatctgggggctccatcggtgggtagggggacagtgggggcagttctgggcccacccagccactgttcctgaccccaagtcctggtgactttctgaggtgcccactcccatccaacctgccttgctggccagccttgtggctttgcccagctgtgtgtgtgagggtggcatgcccacctccagtccagcccagggcggta

SEQ ID NO: 357 - DNA, 620 bp, Homo sapiens
  modified_base (1)...(620): n = g, a, c or t
ctggtggggatggggaccgcctgcccaggggtgagctgccttttgctccacagcggcactaaagacaattcccaatcctgagtgggtggcagagactcctgcgatgcccgtctcangtagctgtggggcaccagcccacaagccgaggttggntctcctaggagtgagaactgcccaagggctgcagaaacaggccacccagctctatctgggggctccaatcggtgggtagggggacagtgggggcagttctgggcccacccagcactgttcctgaacccaagtcctggtgactttctgaggtgcccactcccatccaaactggcttgctggncagccttgtggctttgnccagctgtgtgtgtgagggtggcatgcccanctccagtccagcccagggcggtagcagcaaagcgtggcatcgactcggnntttcttacaaaaaattcataaataatattcactaataatatactcggaacatttgtcggggcttgggggcgttggccccggggaagtccagtgttggggggcaaggccaggttggccctanacgaaggggggccaggggccgttgtgtttgggccccgggccctggggcgcnggtgcttgcacagggc

SEQ ID NO: 358 - DNA, 489 bp, Homo sapiens
ctggtggggatggggaccgcctgcccaggggtgagctgccttttgctccacagccggcactaaagacaattcccaatcctgagtgggtggcagagactcctgcgatgcccgtctcaggtagctgtggggcaccagcccacaagccgaggttggctctcctaggagtgagaactgcccaagggctgcagaaacaggccacccagctctatctgggggctccatcggtgggtagggggacagtgggggcagttctgggcccacccagccactgttcctgaccccaagtcctggtgactttctgaggtgcccactcccatccaacctgccttgctggccagccttgtggctttgcccagctgtgtgtgtgagggtggcatgcccacctccagtccagcccagggcggtagcagcaaagcgtggcatcgcctcggtttcttacaaaaattcataataatattaataataatatactcgacattgtcgggctgg

SEQ ID NO: 359 - DNA, 448 bp, Homo sapiens
  modified_base (1)...(448): n = g, a, c or t
ctggtggggatggggaccgcctgcccgggggtgagctgccttttgctccacagccggcactaaagacaattcccaatcctgagtgggtggcagagactcctgcgatgcccgtctcaggtagctgtggggcaccagcccacaagccgaggttggctctcctaggagtgagaactgcccaagggctgcagaaacaggccacccagctctatctgggggctccatcggtgggtagggggacagtgggggcagttctgggcccacccagccactgtncctgaccccaagtcctggtgactttctgaggtgcccactccacatccaacctgccttgctggncagccttgntggcataatgcccagnctgatagatgcgtgagggnggacatgcccacctaccagtaccagacccagggcggataggcagcaaagnacgtggcatcgcctcggg

SEQ ID NO: 360 - DNA, 317 bp, Homo sapiens
ctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagaccggcccaggccggggccaacacacgcccctgcccctcgtaggcacctgcctgccccacacggactcccgggccacgccccagcccgacaatgtcgagtatattattattaatattattatgaa

SEQ ID NO: 361 - DNA, 177 bp, Homo sapiens
ctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacaa

SEQ ID NO: 362 - DNA, 396 bp, Homo sapiens
  modified_base (1)...(396): n = g, a, c or t
ttggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaattttnngtaagaaaccgaggcgatgccacgcttangctgctaccgccctgggctggactggaggtgggcatgccacc

SEQ ID NO: 363 - DNA, 704 bp, Homo sapiens
  modified_base (1)...(704): n = g, a, c or t
ctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgccccacagcccctggacctgcagcaccgcgcccaggccggggccaacacacgcccctgcccctcgtaggcacctgcctgccccacacggactcccgggccacgccccagccgacaatgtcgagtatattattattaactattattatgaactttttgtaagaaaccgaggcgatgccacgctttgctgctaccggcctggggctggactggaggtgggcatgccaacaccatcacggcacaacagctggcaaaagccaacaaagggccttgggccaggcaagggcacaggttgggactgggagtggggcaccctcangaaaggtcacccagggaactatgggggggtnccagaggaaaccacaggtaggggacctgggggtttngggggccccccaggaaaacttggggcgcccacaaanatngntaccaccaccataaacacacaagcccagaantgtgaaaacccccaacccagagaaantagcagagccatcgaggaaagcaccccaagatacacagcannaccccatgagaa

SEQ ID NO: 364 - DNA, 495 bp, Homo sapiens
  modified_base (1)...(495): n = g, a, c or t
aagctgccttttgctccacagccggcactaaagacaattcccaatcctgagtgggtggcagagactccctttggggcgatgcccgtcttccaggtaaggctgtggtgggcgggccaacacaccaaaaaggggccccccccaaaaatagccccatacaaacaaaacacgnggggcccataccccacgggaaaaggggggtttatgggtgggccattttcccccagtttccacccgtttaacaggcgnggcaacacngctttttgggcgtgnctggaacaacaacccttttgggtctcctccncccaaaaagtagggtgggctgggcggccccttttatgtgtggcccaanacnggagaacacaatactaaataatcccaaactggtgtggggtgtcccgcccaaatancacccaccccaantagatgccccttttaccccgttttataaaaaatttttttttccccctatatcttggcgggggcgaggggatatgt

SEQ ID NO: 365 - DNA, 13793 bp, Homo sapiens
gcccggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctcctcgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccgccccctttctcatcaattggaggctcaactggggccacatcccctctcagcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgagcaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaagaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgaccgctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggaggggaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccgatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagccaaccgccggtcaagattgagtcctcatcgccttctgtgacagaagggcaaacactcgacctcaactgtgtggtggcagggtcagcccatgcccaggtcacctggtacaggcgagggggtagcctgcctcaccacacccaggtgcacggctcccgtctgcggctcccccaggtctcaccagctgattctggagagtatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggcagaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagagtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctcaatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagttaccatcagacccgcggctcacggctgcggctgcaccatgtgtccccggccgactcgggtgaatacgtgtgccgggtgatgggcagctctggccccctggaggcctcagtcctcgtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccacgtctcccctgccgactcaggcgagtatgtgtgtcgtgcagccggcggcccaggccctgagcaagaagcctccttcacagtcaccgtcccgcccagtgaggggtcttcctaccgccttaggagcccggtcatctcgatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggccgtcaccctggagtgtgtcagtgccggggagccccgctcctctgctcgttggacccggatcagcagcacccctgccaagttggagcagcggacatatgggctcatggacagccacacggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcgcaccatccactggtccaagctgcgttccccactgccctggcagcaccggctggaaggtgacacactcatcataccccgggtagcccagcaggactcgggccagtacatctgcaatgccactagccctgccgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccattgtgctgtgcccagcgaccggggtacccagctccgttggttcaaggaagggggtcagctgcctcccggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccaaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcctgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaacgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctatgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggacggccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgacagctccccatgtgagcgccagccttgccaacatggtgccacgtgcatgcccgctggcgagtatgagttccagtgcctgtgtcgagatggaatcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcatctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgagcgatgccacgctttgctcgtaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcccc

SEQ ID NO: 366 - protein, 4393 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPAPFLINWRLNWGHIPSQPRVTVTSEGGRGTLIIRDVKESDQGAYTCEAMNARGMVFGIPDGVLELVPQRAGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCKKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADRSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGRGPHYFYWSREDGRPVPSGTQQRHQGSELHFPSVQPSDAGVYICTCRNLHRSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASQPPVKIESSSPSVTEGQTLDLNCVVAGSAHAQVTWYRRGGSLPHHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPRVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSYHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHHVSPADSGEYVCRAAGGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHTVLQISSAKPSDAGTYVCLAQNALGTAQKQVEVIVDTGAMAPGAPQVQAEEAELTVEAGHTATLRCSATGSPARTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVQPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRTAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGIKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSIYIGGAPDVATLTGGRFSSGITGCVKNLVLHSARPGAPPPQPLDLQHRAQAGANTRPCPS

SEQ ID NO: 367 - DNA, 534 bp, Homo sapiens
  modified_base (1)...(534): n = g, a, c or t
atatgctcatccagatcaaaacgcaggtggaggcctcggaggagagcgccctcaaccacctccagaacccgggcgacgcggccgagggccgggcggccaagaggtgcgagaaggccgaggagaaggccgancggaagatttgctgaaaactngcatgtagatgcttggtggagctgtgtccggctggattagcagtaagagcgaagttcagtcggtgagcgcggtcgggcggttttccagggtccgatgggattctcttggccaaccttggtggtagatgtggcttgactacccttggaaggaaaggcctggataagcctagaagaagcccctttttggttgtatctcttctngttctttcctgtctattncctatcttgctcttcagcttttananagtttaacaggntgtctgcttgggcataattgggctcatgatgggtattcgatgaccctttcgaatcatggaangtttttcggaattttgttaaacggtggtgtgagtagattttacgggggaaaaggttaaattgt

SEQ ID NO: 368 - DNA, 373 bp, Homo sapiens
atatgctcatccagatcaaaacgcaggtggaggcctcggaggagagcgccctcaaccacctccagaacccgggcgacgcggccgagggccgggcggccaagaggtgcgagaaggccgaggagaaggccaagggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttttcctgtctatgctctgtctcactttaacactacgttttctgctatgggtcctggtgagattgatgacc

SEQ ID NO: 369 - DNA, 529 bp, Homo sapiens
  modified_base (1)...(529): n = g, a, c or t
atatgctcatccagatcaaaacgcaggtggaggcctcggaggagagcgccctcaaccacctccagaacccgggcgacgcggccgagggccgggcggccaaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaaccagagagcctttgtgtttcctcttttttttccctgtctatgctctgtcctcacttaacactacgtttcctgctatggtcatgtggttgatgaccctcaatatgagtttcgaatggtaacgtgtatagagtagtgggaagtaatttggtttgaanaatgctctcacaatacagggaattagggacctaggattgtaagctcttgccaggcaggtcaacattttgttcccggggctttggggggtaatttcta

SEQ ID NO: 370 - DNA, 595 bp, Homo sapiens
ccccgttgaagtctggtcctttcttcagtagttgctgcatggagtcgtcttccagaattaatgcagctccttcagcacctccagagctggagaactccaactgtgagtctcatgtgtcacacacagacccaaagttccagggagctatcaggtcacacaagaaatagcaaagcacctcaaaaatttagaaataaccaccaaagcccgggaacaaatgtgactgctgcaagagcttacaatctaggtcctaattcctgtatgtgagagcattttcaaacaaaattacttcccaaacaaaaacacgttaacaatcgaaactcatattgaggtcatcaaccacagaccatagcagaaaacgtagtgttaagtgagacagagcatagacaggaaaaaaaagagaaaacaaaaggctctctggtttcggcttctccagggtgtcagccaatctccaccagttgaccagaatccattggctggaaaccgccgaccgcgctcacgacgactcgctcttctctatccgccggaccagctccaccagcatcttctgccatcttcgcaatctccttggccttctcctcggcttctcgcacctctt

SEQ ID NO: 371 - DNA, 481 bp, Homo sapiens
ccccgttgaagtctgatcctttcttcagtagttgctgcatggagtcgtcttccagaattaatgcagctccttcagcacctccagagctggagaactccaactgtgagtctcatgtgtcacacacagacccaaagttccagggagctatcaggtcacacaagaaatagcaaagcacctcaaaaatttagaaataaccaccaaagcccgggaacaaatgtgactgctgcaagagcttacaatctaggccctaattcctgtatgtgagagcattttcaaacaaaattacttcccaaacaaaaacacgttaacaatcgaaactcatattgaggtcatcaaccacagaccatagcagaaaacgtagtgttaagtgagacagagcatagacaggaaaaaaaagagaaaacaaaaggctctctggtttcggcttctccagggtgtcagccaatctccaccagttgaccagaatccattggctggaaac

SEQ ID NO: 372 - DNA, 472 bp, Homo sapiens
ccccgttgaagtctggtcctttcttcagtagttgctgcatggagtcgtcttccagaattaatgcagctccttcagcacctccagagctggagaactccaactgtgagtctcatgtgtcacacacagacccaaagttccagggagctatcaggtcacacaagaaatagcaaagcacctcaaaaatttagaaataaccaccaaagcccgggaacaaatgtgactgctgcaagagcttacaatctaggccctaattcctgtatgtgagagcattttcaaacaaaattacttcccaaacaaaaacacgttaacaatcgaaactcatattgaggtcatcaaccacagaccatagcagaaaacgtagtgttaagtgagacagagcatagacaggaaaaaaaagagaaaacaaaaggctctctggtttcggcttctccagggtgtcagccaatctccaccagttgaccagaatccattg

SEQ ID NO: 373 - DNA, 555 bp, Homo sapiens
  modified_base (1)...(555): n = g, a, c or t
ccccgttgaagtctggtcctttcttacagtagttgctgcatggagtcgtcttccagaattaatgcagctccttcagcacctccagagctggagaactccaactgtgagtctcatgtgtcacacacagacccaaagttccagggagctatcaggtcacacaagaaatagcaaagcacctcaaaaatttagaaataaccaccaaagcccgggaacaaatgtgactgctgcaagagcttacaatctaggccctaattcctgtatgtgagagcattttcaaacaaaattacttcccaaacaaaaacacgttaacaatcgaaactcatattgaggtcatcaaccacagaccatagcagaaaacgtagtgttaagtgagacagagcatagacnggaaaaaaaagagaaaacaaaaggctctctggtttcggcttctccagggtgtcagccaatctccaccagttggccagaatccattggctggaaaccgccgaccgcgctcacgacgactcgctcttctctatccgccggaccagctccaccagcatctctgccatcttc

SEQ ID NO: 374 - DNA, 394 bp, Homo sapiens
aatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtctggcggatagagaagagcgagtcgtcgtgagcgcggtcggcggtttccagccaatggattctggtcaactggtggagattggctgacaccctggagaagccgaaaccagagagccttttgttttctcttttttttcctgtctatgctctgtctcacttaacactacgttttctgctatggtctgtggttgatgacctcaatatgagtttcgatgtgttaacgt

SEQ ID NO: 375 - DNA, 236 bp, Homo sapiens
ccccgttgaagtctggtcctttcttcagtagttgctgcatggagtcgtctttccagaattaatgcagctccttcaggcacctccagagctggagaactccaactgtgagtctcatgtgtcacacacagacccaaagttccagggagctatcaggtcacacaagaaatagcaaagcacctcaaaaatttagaaataaccaccaaagcccgggaacaaatgtgactgctgcaagagct

SEQ ID NO: 376 - DNA, 441 bp, Homo sapiens
atatgctcatccagatcaaaacgcaggttgaggcctcggaggagagcgccctcaacacctccagaacccgggcgacgcggcgaggccgggcgggcaaaagtgcgagaaggccgaggagaaggcccaggagattgcgaagattgcagagatgctggtggagctggtccggcggatagagaagagcgagtcgtcgtgagcgcggtcggcggtttccagcccatggattctggtcaactggtggagattggctgacaccctggagaagccgaaaccagagagccttttgttttctcttttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaatta

SEQ ID NO: 377 - DNA, 1534 bp, Homo sapiens
ttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgacagtatggaactgtctgcattggaccctaaactggactagaagaggcatcttcaaggttcatacgttgtccagctgtaagttcatttgagtagcagacctaacaaatatttgaggtcagaaccctaccatgttaaaacaaacaaaaacttaccatgttaataaaagtattcatttgc

SEQ ID NO: 378 - protein, 127 aa, Homo sapiens
MRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKAEEKAKEIAKMAEMLVELVRRIEKSESS

SEQ ID NO: 379 - DNA, 646 bp, Homo sapiens
cgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatgaagagaccaatggagaaacaagagttaaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgagaaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccggaagaaattccaaattacagaaatgcagtcattgtagctagtctcctgatgctgcaaagagggcccagtcctatgcggagagactgcgtctgggttttggccgtcattcacggggaagctcagtgcacggaactgg

SEQ ID NO: 380 - DNA, 317 bp, Homo sapiens
  modified_base (1)...(317): n = g, a, c or t
ctgcccggccccggttccccctgccnggccatgaacgccgctctgcaccggctaccgagtcttctcggccaactccacggccgcctgcacggagctggccaagcgcatcacagagcgccttggtgctgaattggggaagtctgttgtatatganagagaccaatggaggaaaccaagagttacacanagtacaaagaantctgttcgttggccaaggatattttcattatacagacaattaacccagagatgtgaatacagctgtgatggagttgctcatcatggcttacgcactgaagactgcctgtgccaggaac

SEQ ID NO: 381 - DNA, 186 bp, Homo sapiens
cgcccgccccgttcccccgccggccatgaacgccgtcgcaccggtaccgagtcttctcggcaactccacggcgcctgacggagctggccaagcgcatacagagcgccttggtgctgaattggggaagtctgttgtatattaagagaccaatgggaaacaagagttaaataaaagatctgttcgtgg

SEQ ID NO: 382 - DNA, 712 bp, Homo sapiens
  modified_base (1)...(712): n = g, a, c or t
cgcccgccccngtttcccccgccggccatgaacgccgctcgcacccggtaccgagttcttctcggccaactccacggccgcctgcacggagccttggccaagccgcatcacagagcgccttggtgctgaatgggggaagtctgtggtatatgaagagaccaatggaggaaacaagagttaaaataaaagaattctgttcgtggccaagattatttttcatttatacagacaattacccagagatgttgaattacagcttgttgattggagtttgctcattcatggctttacgccactgaagacttgccttgttgccaggaacatttattggggtcatccccttacttcccctacagcaagcagagcaaagatgagaaagaggggttccattgtgtgcaagctgcttaggcaatccatgctggccgaaaagcnggtttaactcacattatcactatggatcttcatcaaaaggaaatacaagggcttttacaagctttccttgtggaacaaaccctttagaagccttcaacctttttcctgcttcagtatatcccaggaaggaaattccaaattaccagaaatgcaggtcatttggtagctaagtctccctgatgccttgccaaggangggccagtcctattcggagaanacatgcgtctggttgggccggaantcacacgggaaaccncatgcacagaactcnggaccttgg

SEQ ID NO: 383 - DNA, 701 bp, Homo sapiens
cgcccgccccggttccccgccggccatgaacgccgctcgcaccggctaccgagtcttctcggccaactccacggccgcctgcacggagctggccaagcgcatcacagagcgccttggtgctgaattggggaagtctgttgtatatgaagagaccaatggagaaacaagagttaaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgagaaagaggggttccattgtgtgcaagctgctagcatccatgctggcgaaagcaggtttaactcacattatcactatgatcttcatcaaaaggaaatacaaggctttttcagctttcctgtggacaaccttagagcctcacctttcctgcttcagtatatccggaagaaattccaaattacagaaatgcagtcattgtagctaacgtctcctgatgctgcaaagagggcccagtcctatgcggagagactgcgtctgggtttggccgtcattcacggggaagctcagtgcacggaactggacattggacgatggtcgtcaactccccgctatggtcaaaatgctactgtgcaccc

SEQ ID NO: 384 - DNA, 1728 bp, Homo sapiens
ggtgcgcaagggcacggacctcggagctctccccgttcccccgccggccatgaacgccgctcgcaccggctaccgagtcttcctcgccaactccacggccgcctgcacggagctggccaagcgcatcacagagcgccttggtgctgaattggggaagtctgttgtatatcaagagaccaatggagaaacaagagttgaaataaaagaatttgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgctatgcctacagccattgaaaaatgaagcattcatgttgttacatcttccaaggatgtcagattagaaaatagcatcccacctctgggtatctgagtggctctgaagttgcaaataaaataatttgttgt

SEQ ID NO: 385 - protein, 356 aa, Homo sapiens
MNAARTGYRVFLANSTAACTELAKRITERLGAELGKSVVYQETNGETRVEIKEFVRGQDIFIIQTIPRDVNTAVMELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 386 - DNA, 413 bp, Homo sapiens
gtgcgtaccatgcagaataccagcgacctggacacagcccgctgcaccaccagcatcctgcacaacctctcccaccaccgggaggggctgctcgccatcttcaagtcgggtggcatcccttctctggtccgcatgctcagctccccttttgagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccagggccctcggtgcacgattatgcgttacttcgttttaaaagc

SEQ ID NO: 387 - DNA, 428 bp, Homo sapiens
ccagtgctgtcgttgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctccccttttgagtcggtcctgtttctatgccatcaccacgctgcacaacctgctcctgtaccaggagggcgccaagatggccgtgcgcctggccgacgggctgcaaaagatggtgcccctgctcaacaagaacaaccccagttcctggccatcaccaccgactgcctgcagctcctggcctacggcaaccaggagagcaagctgatcatcctggccaatggtgggccccaggccctcgtgcagatcatgcgtaactacgttattaaaagctgctc

SEQ ID NO: 388 - DNA, 609 bp, Homo sapiens
tccagtgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctccccttgtggagtctgtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacgttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatttggccaccaggcaggagggc

SEQ ID NO: 389 - DNA, 587 bp, Homo sapiens
ccagtgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtgggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcaga

SEQ ID NO: 390 - DNA, 631 bp, Homo sapiens
tgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctccccttggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctaccagcaacagcccccgcctggtgcagaactgcctgtggaccctgcgcaacctctcagatttggccaccaggcaggagggcctggagagtgtgctgaaagattctggtga

SEQ ID NO: 391 - DNA, 475 bp, Homo sapiens
  modified_base (1)...(475): n = g, a, c or t
agctttttataactgtagttacgcatgatctgcacgagggcctggggcccaccattggccaggatgatcagcttgctctcctggttgccgtagccagagctgcagcagtcgtgtatgccagaacttggggttgttcttgttgagcaggggcaccatcttttgcagcccgtcgccaggcgcacggccatcttggcgccctcctggtacaggagcaggttgtgcagcgtggtgatgcatagaacaggaccgactccacangggagctgagcatgcggaccagagcaggatgccacccacttgaaatgcagcagcccctcccggtgtggagaggttgtgcaggatgctgtggtgcagcgggctgtgtccagtcgctgtattctgcatggtacgcacgacgcgccaccactgggcgagcccatcagggcccgccgcgaccctccttttcgacgctgttcacaatcatgccccttgtcac

SEQ ID NO: 392 - DNA, 648 bp, Homo sapiens
  modified_base (1)...(648): n = g, a, c or t
gagaggcgccatngncggtggcagcggtggctccagtgctgtcgtgcgtaccatgcagaataccagcgacctggacacagcccgctgcaccaccagcatcctgcacaacctctcccaccaccgggaggggctgctcgccatcttcaagtcgggtggcatccctgnctctggtccgcatgctcagctcccctgntggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaggcaggagggcctggag

SEQ ID NO: 393 - DNA, 954 bp, Homo sapiens
  modified_base (1)...(954): n = g, a, c or t
gncggtggcagcggtggctccagtgctgtcgtgcgtaccatgcagaataccagcgacctggacacagcccgctgcaccaccagcatcctgcacaacctcccccaccaccgggaggggctgctcgccatcttcaagtcgggtggcatccctgctctggtccgcatgctcagctcccctgntggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgncaccctgaggncgagaacggcctggccccagtaacgggcccctctntgcaggctttcctcctctctagaanctccttctgttggaaggccctccg

SEQ ID NO: 394 - DNA, 926 bp, Homo sapiens
  modified_base (1)...(926): n = g, a, c or t
gagaggcgccatngncggtggcagcggtggctccagtgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgatggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgngccanctcattagccgccaccctgagggcgagatggnccagaactctgtgcgtcncaactatggcatccca

SEQ ID NO: 395 - DNA, 536 bp, Homo sapiens
  modified_base (1)...(536): n = g, a, c or t
tggtggtccagagcagctttttataactgtagttacgcatgatctgcacgagggcctggggcccaccattggccaggatgatcagcttgctctcctggttgccgtaggccaggagctgnaggcagtcggtggtgatggccangaacttggggttgtncttgttgagcaggggcaccatcttttgcagcccgtcggccaggcgcacggccatcttggcgccctcctggtacaggagcaggttgtgcagcgtggtgatggcatagaacaggaccgactccacaggggagctgatcatgcggaccagagcagggatgccacccgacttgaagatggcgagcagcccctcccggtggtgggagaggttgtgcaggatgctggtggtgcagcgggctgtgtccaggtcgctggtattctgcatggtacgcacgacagcggccaccagctggggcgagcccatcanggcccgncgcgacgcctccttgttcgacagctggtccacaatcatggccgncttggtcaccaccaccgggtcctcg

SEQ ID NO: 396 - DNA, 910 bp, Homo sapiens
  modified_base (1)...(910): n = g, a, c or t
cggnccgaccccgacccggcccggtcaggccccatactcagtagccacgatggaggtgatgaacctgatggagcagcctatcaaggtgactgantggcagcagacatacacctacgactcgggtatccactcgggcgccaacacctgcgtgccctccgncagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggncatgattgtgaaccagctgtcgaacaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggnatccctgctctggtccgcatgctcagctccctgtggagtcggtcctgttctatgccatcaccacctgnacaacctgctcctgtaccaggaggggcgccaanatggccgtgcgcctggccgacggntggaaaanatgtgccctgctcaacagaacaccccaagttctggcatcacacgaat

SEQ ID NO: 397 - DNA, 533 bp, Homo sapiens
  modified_base (1)...(533): n = g, a, c or t
nggtggtccagancagctttttataactgtagttacgcatgatctgcacnagggcctggggcccaccatatggccaggatgatcagcttgctctcctggttgccgtaggccaggagctgcaggcagtcggtggtgatggccaggaacttggggttgttcttgttgagcaggggcaccatcttttgcagcccgtcggccaggcgcacggccatcttggcgccctcctggtacaggagcaggttgtgcagcgtggtgatggcatagaacaggaccgactccacaggggagctgagcatgcggaccagagcagggatgccacccgacttgaanatggcgagcagcccctcccggtggtgggagaggttgtgcaggatgctggtggtgcagcgggctgtgtccaggtcgctggtattctgcatggtacgcacgacagcggccaccagctggggcgagcccatcagggncccgccgcgacgcctccttgttcgacagctggttcacaatcatggccgccttggtcaccaccaccgggt

SEQ ID NO: 398 - DNA, 883 bp, Homo sapiens
tggtggtccagagcagctttttataactgtagttacgcatgatctgcacgagggcctggggcccaccattggccaggatgatcagcttgctctcctggttgccgtaggccaggagctgcaggcagtcggtggtgatggccaggaacttggggttgttcttgttgagcaggggcaccatcttttgcagcccgtcggccaggcgcacggccatcttggcgccctcctggtacaggagcaggttgtgcagcgtggtgatggcatagaacaggaccgactccacaggggagctgagcatgcggaccagagcagggatgccacccgacttgaagatggcgagcagcccctcccggtggtgggagaggttgtgcaggatgctggtggtgcagcgggctgtgtccaggtcgctggtattctgcatggtacgcacgacagcggccaccagctggggcgagcccatcagggcccgccgcgacgcctccttgttcgacagctggttcacaatcatggccgccttggtcaccaccaccgggtcctcgtcgttgagcagtttggtgagctcgggcagggcgcgagtggccagctcggcatcgtcctggtagttgatgagatgcacaatggccgacttgagcagctgggacggctcggccagtcgctgcaggttggtggcctgcccctccacctgggtggccagcagaagcgagctgtcctcgcctgacacaccagggcacatggcctcccgcacccgtttggccctggctgttgtggacatctggtactccaggtcaccttggcttggggggcaccccctgggtgtaagtggtggttttcttgagcgtgtactggcgcccgcaggcctcatcctcctccatgatgcccttgctgc

SEQ ID NO: 399 - DNA, 773 bp, Homo sapiens
tggtggtccagagcagctttttataactgtagttacgcatgatctgcacgagggcctggggcccaccattggccaggatgatcagcttgctctcctggttgccgtaggccaggagctgcaggcagtcggtggtgatggccaggaacttggggttgttcttgttgagcaggggcaccatcttttgcagcccgtcggccaggcgcacggccatcttggcgccctcctggtacaggagcaggttgtgcagcgtggtgatggcatagaacaggaccgactccacaggggagctgagcatgcggaccagagcagggatgccacccgacttgaagatggcgagcagcccctcccggtggtgggagaggttgtgcaggatgctggtggtgcagcgggctgtgtccaggtcgctggtattctgcatggtacgcacgacagcggccaccagctggggcgagcccatcagggcccgccgcgacgcctccttgttcgacagctggttcacaatcatggccgccttggtcaccaccaccgggtcctcgtcgttgagcagtttggtgagctcgggcagggcgcgagtggccagctcggcatcgtcctggtagttgatgagatgcacaatggccgacttgagcagctgggacggctcggccagtcgctgcaggttggtggcctgcccctccacctgggtggccagcagaagcgagctgtcctcgcctgacacaccagggcacatggcctcccgcacccgtttggccctggctgttgtggacatctgg

SEQ ID NO: 400 - DNA, 618 bp, Homo sapiens
tggtggtccagagcagctttttataactgtagttacgcatgatctgcacgagggcctggggcccaccattggccaggatgatcagcttgctctcctggttgccgtaggccaggagctgcaggcagtcggtggtgatggccaggaacttggggttgttcttgttgagcaggggcaccatcttttgcagcccgtcggccaggcgcacggccatcttggcgccctcctggtacaggagcaggttgtgcagcgtggtgatggcatagaacaggaccgactccacaggggagctgagcatgcggaccagagcagggatgccacccgacttgaagatggcgagcagcccctcccggtggtgggagaggttgtgcaggatgctggtggtgcagcgggctgtgtccaggtcgctggtattctgcatggtacgcacgacagcggccaccagctggggcgagcccatcagggcccgccgcgacgccctccttgttcgacagctggttcacaatcatggccgcctttggtcaccaccaccgggtcctcgtcgttgagcagtttggttaagctcgggcagggcgcgagtggccagctcggcatcgtcctggtagttgatgagatgcacaa

SEQ ID NO: 401 - DNA, 750 bp, Homo sapiens
  modified_base (1)...(750): n = g, a, c or t
cangagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgacctggtgcagaactgcctgtggaccctgcgcaacctctcagatgtggccaccaggcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgccccagcccaaccatgccccgctgcaggaggcagnggtcatccccgcctcgtccaactgctggtgaangcccaccaggatgcccagngccacgtanctgcaggcncaccgcagc

SEQ ID NO: 402 - DNA, 858 bp, Homo sapiens
  modified_base (1)...(858): n = g, a, c or t
ccctgnataatacnttagtgtggatgacgtcaangtcctcnnctgctgccacggggacactctccaacctgacatgcaacaacagcaagaacaagacgctggtgacacagaacagcggtgtggaggctctcatccatgccatcctgcgatgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggtcgacgccattgatgcaganggggcctcggccccactcatggagttgctgcactcccgcaacgagggcactgccacctacgctgctgcccgtcctgttccgcatctccgangacaanaacccagactaccggaancgcgtgtccgtggagctcaccaactcccttcttcangcatgaacccggctgcc

SEQ ID NO: 403 - DNA, 935 bp, Homo sapiens
  modified_base (1)...(935): n = g, a, c or t
gcacactgnactgatcnggtatctggcccnntgcccagccaaccatgccccgctgcaggaggcagcggatcatcccccgcctcgctccaactgctggtgaaggcccaccaggatgcccagcgccacgctagctgcaggcacacagcagccctacacggatggtgtgaggatggaggagattgtggagggctgcaccggagcactgcacatcctcgcccgggaccccatgaaccgcatggagatcttccggctcaacaccattcccctgntttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgactnggatgccacctaccgccccatgtactccagcgatgtgccccttgaacccgctggagatgcacatggacatggatggagactaccccatcgacacctacagnganggcctcaggcccccgtaccccactgnagaccacatgctgnnctacgcggcctggccccagtacggncccctctttgcaggcttttcctcctctctagaaacctccttctgttggaggccctcncaaaacccancagnacaacccaccacagnggttacatagataaagcgnccgntcgactantctgaggtctgatactcactgactgtcntacacagtgaacctataaantaaaa

SEQ ID NO: 404 - DNA, 514 bp, Homo sapiens
  modified_base (1)...(514): n = g, a, c or t
aaccctntgaatgncgaccctttgtgtgagctggcccaggacaaggcaggcggccgacgccattgatgcanagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccct

SEQ ID NO: 405 - DNA, 256 bp, Homo sapiens
  modified_base (1)...(256): n = g, a, c or t
agggcctccaacagaaggaggttctagagaggaggaaaagcctgcaaagagggggccgtactggggccaggccgcctaggccancatgtggtctgcagtggggtacgggggcctgaggccgtcgctgtaggtgtcgatggggtagtctccatccatgtccatgtgcatctccagngggtcaaggggcacatcgctggagtacatggggcggtaggtggcatccaagtcatctccatagggctcattgatgggaatc

SEQ ID NO: 406 - DNA, 3490 bp, Homo sapiens
cgccagagtccggagcagccgccgcccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctccggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacag

SEQ ID NO: 407 - protein, 745 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 408 - DNA, 3192 bp, Homo sapiens
cgccagagtccggagcagccgccgcccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctccggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacag

SEQ ID NO: 409 - protein, 745 aa, Homo sapiens; identical to SEQ ID NO: 407

SEQ ID NO: 410 - DNA, 495 bp, Homo sapiens
  modified_base (1)...(495): n = g, a, c or t
aggcangntacaagtgtgatggcaatgtgactggaacagaaatagtttctatccaggcacatcaataagctccctgtaatgccccgtagattccatcctgcaaaagtggccctcagttggcgacacccacgtgtctgcatgatccccgcagttgtgtgctacgcacgtaggacgagcgttggaatgcaaggttgccccanatcggtcccgcanggcttcaccgtctggtttggatgacctatctaaggggaagtttcgtgcttctaaacgattcttcttctccaaagggtctcaaggggtcggtagactatgggagcgattttgaccttaaaaaggttcncttcccaagngagagaagggcccaacgggagtccttgggacgaagcgagggagtcctgtgcttttactcaacatctgtcttaatcaatagagtgncaagatgctctatcgtgctttccccttcagagaagtgaggttcaattgtaacagcataac

SEQ ID NO: 411 - DNA, 570 bp, Homo sapiens
tcggagtttcttctttcccgatgcatctccagttttgtcccagatgaaggcgtctttccccagggtcaggggttccatcacttggcccatgaaaaggactgttcctgtggggttgtgccggaacaacaaagaggaagggtctgtccatgatgatctcctcgggggccatgcgggctgagactatgacagctgtggatgaggaggccaccgtgccactctcgttcacctcgatcttcactttctgcagcgcctgcgcgacgtgagaggctcttggtctgaaagactcgtgaagtcagcctgaaactgtctgaacatgtcggtcattcccaggttctctaggggcttcctgaggtcgacttcagtctccagggagaacttgggcagaaccaggaggcggggcagcctggtcatgttgcctttccagtggctgatgagctgggcactcagaatgttggtgagggcagagagaggcacctctttttcataaggggcagcaatgaacatgctgagggtgtccccgtggtagggcagttccaggatgtcgtataatggccatcgggcgtggtgaac

SEQ ID NO: 412 - DNA, 387 bp, Homo sapiens
gacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctccatcaagccactggaaaggcaacatgaccaggggc

SEQ ID NO: 413 - DNA, 543 bp, Homo sapiens
gacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagactcgtttcaggctgacttcacgagtctttcagaccaagagcctctccacgtcgcgcaggcctgag

SEQ ID NO: 414 - DNA, 301 bp, Homo sapiens
gacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgaggttcaccacgcccgatggccattactacgacatccctggaactgccctaccacggggacaccctcagcatgttcattgctgcccctt

SEQ ID NO: 415 - DNA, 515 bp, Homo sapiens
aggcagtacaagtgtgatggcaatgtgactggaacagaaatagtttctaccaggcacacaaaagctcctgtaagccccgtagttccatcctgcaaagggcctcagtgggaaccagtcttggcaacccatgggcagagagacgggtggaagcaggtgccccagatggtcccgcaggcgtcaccgtctggtttggagaccttaagggagttgtgcttcaaacttctctcccaggggtctcaggtggagactagggagtttgacctaaaggtcctccaaggagaggccaaggtcttggagacagatctggtttaccatcttttaacaaaaggcaaatgtcttctcttccttcagaaagagtcattaacactaaaattcttttcttcggagtttcttctttcccgatgcatctccagttttgtcccagatgaaggcgtctttccccaggggtcaggggttccatcacttggcccatgaaaaggactgttcctgtggggttgtgccggaccacaaagagg

SEQ ID NO: 416 - DNA, 420 bp, Homo sapiens
aggcagtacaagtgtgatggcaatgtgactggaacagaaatagtttctaccaggcacacaaaagctcctgtaagccccgtagttccatcctgcaaaggggcctcagtgggaaccaggtctgcagacccgagtgggcagagagacgggtggaagcaggtgccccagatggtcccgcaggcgtcaccgtctggtttggagaccttaagggagttgtgcttcaaacttctctcccagggtctcaggtggagactagggagtttgacctaaaggtcctccaaggagaggccaaggtcttggagacagatctggtttaccatcttttaacaaaaggcaaatgtcttctcttccttcagaaagagtcattaacactaaaattcttttcttcggagtttcttctttcccgatgcatctccagttttg

SEQ ID NO: 417 - DNA, 523 bp, Homo sapiens
  modified_base (1)...(523): n = g, a, c or t
cagctggancgagctcggatcacttantaacggccgccagtgtgctggaattcgcccttctctcggcatggacgagctgtacaaggaggaggcgccaaggccggtggcagcggtggctccagtgtgctgggttcttgcggaggcagtacaagtgtgatggcaatgtgactggaacagaaatagtttctaccaggcacacaaaagctcctgtaagccccgtagttccatcctgcaaaggggcctcagtgggaaccaggtctgcagacccgagtgggcagagagacgggtggaagcaggtgccccagatggtcccgcaggcgtcaccgtctggtttggagaccttaagggagttgtgcttcaaacttctctcccagggtctcaggtggagactagggagtttgacctaaaggtcctccaaggagaggccaaggtcttggagacagatctggtttaccatcttttaacaaaaggcaaatgtcttctcttccttcagaaagagtcattaacactaaaattcttttct

SEQ ID NO: 418 - DNA, 486 bp, Homo sapiens
aggcagtacaagtgtgatggcaatgtgactggaacagaaatagtttctaccaggcacacaaaagctcctgtaagccccgtagttccatcctgcaaagggcctcagtgggaaccaggtctgcagacccagtgggcagagagacgggtggaagcaggtgccccagatggtcccgcaggcgtcaccgtctggtttggagaccttaagggagttgtgcttcaaacttctctcccagggtctcaggtggagactagggagtttgacctaaaggtcctccaaggagaggccaaggtcttggagacagatctggtttaccatcttttaacaaaaggcaaatgtcttctcttccttcagaaagagtcattaacactaaaattcttttcttcggagtttcttctttcccgatgcatctcccgttttgtcccagataaggcgtctttccccagggtcaggggttccatcacttggcccatgaaaaggactgttcct

SEQ ID NO: 419 - DNA, 2876 bp, Homo sapiens
gaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagc

SEQ ID NO: 420 - protein, 402 aa, Homo sapiens [sequence omitted]

SEQ ID NO: 421 - DNA, 428 bp, Homo sapiens
acactgccctccttcttgagggtcccagcctgcgatgatgattcccgccatcaggtcttcccggtatcggtaacacatctccttaaagagactggctgctgtgtggaccagtggaggctcattcagttcaatgctgtggaaaccgagctggtaggtgacagcatcagctactgcctgggtatcagcagctgagcctgagcgacagcagaaaatgcggtcgtgaataggtgtcagcttgtcagtcactcgattggcgatgtaggacccagtggttgttctggagtccgcccccagaaccacgcccccgtcaaactgcacggccatgatagtggtcccagtggaaacttctcggctttcccagtctggagtgaacgcctccggcccccaagccggtgctggcccggctccccgagcagctagtaaggtag

SEQ ID NO: 422 - DNA, 622 bp, Homo sapiens
  modified_base (1)...(622): n = g, a, c or t
cgaactgctcggtgcccgccgtatccaggatctccagcaccgacggcgacgagtccacctcaatctccttgcggtaaaagtcttcgatggtcgggtcgtacttctcgatgaaggagcccgtcacgaactgcacggtgagcgcggacttgcccacgccgcccgagcccagcaccaccactttgtactctctcatggctccgtcagcgctctcgccgcgcctgccgcggccccgtcggggctgcgcgcgggaaaggctgggcttggcgggctggacttctcttccccttcctcagctacgcaggaaaaacccaggagagagcaacccagagaacgcagggcggaaaccaccgaaacggaaggcgggccgccaggcccggcccggcggccggcgggcaaggcgntaatccctgggggctagcacggggtcccgggggcccacggaaggcaaggtcaccggnaggcaggcaaggacangacagccccnggnggacgggcagaaaacccgggaangaggggacaaattggcccacggcaagcctttggcgncacgngaagaaaaaccacaagggcaacaaggggggngttaacgncattaaggaataacacagcgcggagccgagag

SEQ ID NO: 423 - DNA, 515 bp, Homo sapiens
  modified_base (1)...(515): n = g, a, c or t
cgcagctgcgggcattgtcctctcggttcgccgcccgggctgctgctgccgccgcggactgctgcggggcccggacccgcaccccagggatacgctgccgccgtcgccggccggcccgggcccggcctccgttcggtggtttccgccctgcgttctctgggttgctctctcctgggtttttcctgcgtagctgaggaaggggaagagaagtccagccgccaagcccagccttccccggcgcagccccgacggggccgccggacaggcgcgggcggagaagcgctgacggagccatgaggagagtacacaagtggtggtgctagggctcgaggcaggagtggggcaaagtccgcagacttcaaccgtggcaagatacggttggaacacggggcatccttcaatcgnagaaaaggtacgaacccgaacncatcgaaagaactttttaaccggccaaggnagnaatggagagtgggacctcaggnctacgncccgtcccgggangcttggaagaatcc

SEQ ID NO: 424 - DNA, 458 bp, Homo sapiens
  modified_base (1)...(458): n = g, a, c or t
cgaactgctcggtgcccgccgtatccaggatctccagcaccgacggcgacgagtccacctcaatctccttgcggtaaaagtcttcgatggtcgggtcgtacttctcgatgaaggagcccgtcacgaactgcacgggtgagcagcggacttgcccanagaccggaccgagcccagacacacaccactatatgtactcatctcaatggcatccgncagagctcatcgnccgacagacctgccgnnggaccccgatacaggggggcattgcagcgcggnggaaaagggcatnggggncataggacagggacaatagggaacagntatcatcattcacacacatatcgcatcaaagcnatacgcaaagggaaaaacaanaacgcccaagagaagaaagaggcaaaacccccaaggaanngaaaacaacagggccaacaagaggggaccggggaggaaaaaaa

SEQ ID NO: 425 - DNA, 447 bp, Homo sapiens
  modified_base (1)...(447): n = g, a, c or t
cgaactgctcggtgcccgccgtatccaggatctccagcaccgacggcgacgagtccacctcaatctccttgcggtaaaagtcttcgatggtcgggtcgtacttctcgatgaaggagcccgtcacgaactgcacggtgagcgcggacttgcccacgccgcccgagcccagcaccaccactttgtactctctcatggctccgtcagcgctctcgccgcgcctgccgcggccccgtcggggctgcgcgcggggaaggctgggcttggcaggctggacttctcttccccttcctcagctacgcaggaaaaacccaggagagagcaacccagagaacgcagggcgggaaaccaccgaacggaggccgggcgccgggccgtccggccggacganggcagtgcgggggcgaaccgagaggaacaaatgcccgagaggcccttgcggccgaaaaa

SEQ ID NO: 426 - DNA, 382 bp, Homo sapiens
  modified_base (1)...(382): n = g, a, c or t
cgaactgctcggtgcccgccgtatccaggatctccagcaccgacggcgacgagtccacctcaatctccttgcggtaaaagtcttcgatggtcgggtcgtacttctcgatgaaggagcccgtcacgaactgcacggtgagcgcggacttgcccacgccgcccgagcccagcaccaccactttgtactctctcatggctccgtcagcgctctcgccgcgcctgccgnggccccgtcggggctgcgcgcggggaaggctgggcttggcggctggacttctcttccccttcctcagntacgcaggaaaaacccaggaggagagcaacccaggagaacgcagggcggaaagcacgcggaacggagtgccgggcgccgggccggcccg

SEQ ID NO: 427 - DNA, 560 bp, Homo sapiens
cgaactgctcggtgcccgccgtatccaggatctccagcaccgacggcgacgagtccacctcaatctccttgcggtaaaagtcttcgatggtcgggtcgtacttctcgatgaaggagcccgtcacgaactgcacggtgagcgcggacttgcccacgccgcccgagcccagcaccaccactttgtactctctcatggctccgtcagcgctctcgccgcgcctgccgcggccccgtcggggctgcgcgcggggaaggctgggcttggcggctggacttctcttccccttcctcagctacgcaggaaaaacccaggagagagcaacccagagaacgcagggcggaaaccaccgaacggaggccgggcgccgggccggccggcggcggcggcagcgtatccctggggtgcgggtccgggccccgcagcagtccgcggcggcagcagcagcccgggcggcgaaccgagaggacaatgcccgcagcctgcgccgcagaacccagcacagtggttagatagataaagcggcgctcgactagtctgaggtctgatactcactgactgaa

SEQ ID NO: 428 - DNA, 1733 bp, Homo sapiens
gcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaatgtgatttatttcttgctttgagattggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggatgaaaaggagggagagaaggtggaaatggtttttttttttttttttctattttctttctttttttttttttttttttttggtcaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtgg

SEQ ID NO: 429 - protein, 183 aa, Homo sapiens
MREYKVVVLGSGGVGKSALTVQFVTGSFIEKYDPTIEDFYRKEIEVDSSPSVLEILDTAGTEQFASMRDLYIKNGQGFILVYSLVNQQSFQDIKPMRDQIIRVKRYERVPMILVGNKVDLEGEREVSYGEGKALAEEWSCPFMETSAKNKASVDELFAEIVRQMNYAAQPNGDEGCCSACVIL

SEQ ID NO: 430 - DNA, 563 bp, Homo sapiens
  modified_base (1)...(563): n = g, a, c or t
cggcagaaaacagagcctgcctaaccaggcccagccagttggtggggccaggccaggaccacacagtccccagactcagctggaagtctacctgctggacagcctccgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacaggcccttcagccccttctccnctccccgcctggccagggcagggccaccccactctacctccttagctttccctgtgccactttgactcagaggctgggagcatagcagaggggccaggcccaggcagagctgacgggaggccccagctctgaggggagggggtc

SEQ ID NO: 431 - DNA, 478 bp, Homo sapiens
  modified_base (1)...(478): n = g, a, c or t
cggcagcaaaacagancctgcctaaccaggacccanccagttggtggggccaggccaggaccacacagtccccagactcagctggaagtctacctgctggacagcctccgccaagatctacaggacaaagggagggagcaagtcctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagccccttcagccccttctccnctccccgactggccagggcagggccaccccactctacctcctnanattcccctgtgc

SEQ ID NO: 432 - DNA, 743 bp, Homo sapiens
  modified_base (1)...(743): n = g, a, c or t
gccagtgtttattagcaagatggaacccaaaggcggctgtggcctgggcagcagaaggccaccaggagcccccacccatctacccaactgccccccagagctaattacatccacacccatcccctgaagtggtggacataagggagccctggggagcctctaccggccccaggcctctaccacggaccccctcccctcagagctggggcctcccgtcagctctgcctgggcctggcccctctgctatgctcccagcctctgagtcaaagtggcacagggaaagctaaggaggtagagtggggtggccctgccctggccaggcggggaggggagaaggggctgaaggggctgtcccacccaggcaggatgcctcttctcctatccccaataaatagagaataaatacccaggaaggggctggtcgtggctgagtgcccccaacccaggcaggggctggcatcctgtgatggccccttcttcccttctctgtgtgctcttgaggccaccccagtctccaaagtggtcctcgcatccatgtctatgccacagcacaggctgacaacacacatcanaaaaggtggacagtccgtgccccatccgagtagggcttgctccctccctttgtcctgtagatcttggcggangctgtccagcaggtanacttccagctgantctggggactgtgtggtcctggcctggcccaccaactggntggcctggttaggcaggtctgttttcttgc

SEQ ID NO: 433 - DNA, 636 bp, Homo sapiens
  modified_base (1)...(636): n = g, a, c or t
cggcagaaaacagagcctgcctaaccaggcccagccagttggtggggccaggccaggaccacacagtccccagactcagctggaagtctacctgctggacagcctccgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagccccttcagccccttctccnctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtg

SEQ ID NO: 434 - DNA, 635 bp, Homo sapiens
  modified_base (1)...(635): n = g, a, c or t
gccagtgtttattagcaagatggaacccaaaggcggctgtggcctgggcagcagaaggccaccaggagcccccacccatctacccaactgccccccagagctaattacatccacacccatcccctgaagtggtggacataagggagccctggggagcctctaccggccccaggcctctaccacggaccccctcccctcagagctggggcctcccgtcagctctgcctgggcctggcccctctgctatgctcccagcctctgagtcaaagtggcacagggaaagctaaggaggtagagtggggtggccctgccctggccaggcggggaggggagaaggggctgaaggggctgtcccacccaggcaggatgcctcttctcctatccccaataaatagagaataaatacccaggaaggggctggtcgtggctgagtgcccccaacccaggcaggggctggcatcctgtgatggccccttcttcccttctctgtgtgctcttgaggncaccccagtctccaaagtggtcctcgcatccatgtctatgccacagcacaggctgacaacacacatcanaaaaggtggacagtccgtgccccatccgantagggcttgctccctccctttgtcctgtaaatc

SEQ ID NO: 435 - DNA, 586 bp, Homo sapiens
  modified_base (1)...(586): n = g, a, c or t
gccagtgtttattagcaagatggaacccaaaggcggctgtggcctgggcagcagaaggccaccaggagcccccacccatctacccaactgccccccagagctaattacatccacacccatcccctgaagtggtggacataagggagccctggggagcctctaccggccccaggcctctaccacggaccccctcccctcagagctggggcctcccgtcagctctgcctgggcctggcccctctgctatgctcccagcctctgagtcaaagtggcacagggaaagctaangaggtagagtggggtggccctgccctggccaggcggggaggggagaaggggctgaaggggctgtcccacccaggcaggatgcctcttctcctatccccaataaatagagaataaatacccagnaaggggctggtcgtggctgagtgcccccaacccangcaggggctggcatcctgtgatggccccttcttcccttctctgtgtgctcttgaggccaccccagtctccaaagtggtcctcgcatccatgtctatgccacagcacaggctgacaacacacatcanaaaaaggtggacag

SEQ ID NO: 436 - DNA, 748 bp, Homo sapiens
gccagtgtttattagcaagatggaacccaaaggcggctgtggcctgggcagcagaaggccaccaggagcccccacccatctacccaactgccccccagagctaattacatccacacccatcccctgaagtggtggacataagggagccctggggagcctctaccggccccaggcctctaccacggaccccctcccctcagagctggggcctcccgtcagctctgcctgggcctggcccctctgctatgctcccagcctctgagtcaaagtggcacagggaaagctaaggaggtagagtggggtggccctgccctggccaggcggggaggggagaaggggctgaaggggctgtcccacccaggcaggatgcctcttctcctatccccaataaatagagaataaatacccaggaaggggctggtcgtggctgagtgcccccaacccaggcaggggctggcatcctgtgatggccccttcttcccttctctgtgtgctcttgaggccaccccagtctccaaagtggtcctcgcatccatgtctatgccacagcacaggctgacaacacacatcagaaaaggtggacagtccgtgccccatccgagtagggcttgctccctcccttttgtcctgtagatcttggcggaggctgtccagcaggtagacttccagctgagtctggggactgtgtggtcctggcctggccccaccaactggctgggcctggttaggcaggctctgttttctgccg

SEQ ID NO: 437 - DNA, 3552 bp, Homo sapiens
ctgactggtgctccctctctttcatcttgggctgtctgcatgtgtctcattcccccactctctcctgtgcctcccctctactctaataatcaggtccaggtttctctgtactgggagaagacctgtggctggagcaggcagggatgcaccctatctgttccccattcctccaggtgggagggagaaggagtaacccactttattggccacagatgcaggggagaaaggagaaagcatgctgggagctggaaagagccctaagatcacctggtttctagagagtggagcctgcttcctgcctaggcccctcccacaatgcttgtcgccggtcttcttctctgggcttccctactgactggggcctggccatccttccctacccaggaccacctcccggccacgccccgggtacggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagaggggcccaactaccagtggatgcccttctcagggaagatgccctacccacggccgggcacgtgccctggtggaaccttcacgccatctatgaagtccaccaaggattatcctgatgaggtgatcaacttcatgcgcagccacccactcatgtaccaggccgtgtaccctctgcagcggcggcccctggtagtccgcacaggtgctccctaccgccttaccactattgccgtggaccaggtggattcagccgacgggcgctatgaggtgcttttcctgggcacagaccgcgggacagtgcagaaggtcattgtgctgcccaaggatgaccaggagatggaggagctcatgctggaggaggtggaggtcttcaaggatccagcacccgtcaagaccatgaccatctcttctaagaggcaacaactctacgtggcgtcagccgtgggtgtcacacacctgagcctgcaccgctgccaggcgtatggggctgcctgtgctgactgctgccttgcccgggacccttactgtgcctgggatggccaggcctgctcccgctatacagcatcctccaagaggcggagccgccggcaggacgtccggcacggaaaccccatcaggcagtgccgtgggttcaactccaatgccaacaagaatgccgtggagtctgtgcagtatggcgtggccggcagcgcagccttccttgagtgccagccccgctcgccccaagccactgttaagtggctgttccagcgagatcctggtgaccggcgccgagagattcgtgcagaggaccgcttcctgcgcacagagcagggcttgttgctccgtgcactgcagctcagcgatcgtggcctctactcctgcacagccactgagaacaactttaagcacgtcgtcacacgagtgcagctgcatgtactgggccgggacgccgtccatgctgccctcttcccaccactgtccatgagcgccccgccacccccaggcgcaggccccccaacgcctccttaccaggagttagcccagctgctggcccagccagaagtgggcctcatccaccagtactgccagggttactggcgccatgtgccccccagccccagggaggctccaggggcaccccggtctcctgagccccaggaccagaaaaagccccggaaccgccggcaccaccctccggacacatgaggccagctgcctgttctgccatgggcagcctagcccttgtcccttttaatataaaagacatatatatatatatatatatatatatataaaaatatctatattctatacacaccctgcccctgcaaagacagtatttattggtgggttgaatatagcctgcctcagtggcagcatcctccaaaacttagacccatgctggtcagagacggcagaaaacagagcctgcctaaccaggccagccagttagtggggccaggccaggaccacacagtccccagactcagctggagtctacctgctggacaggccttgcgccaagatctacaggacaaagggagggagcaagccctactcggatggggcacggaccgtccacctttctgatgtgtgttgtcagcctgtgctgtggcatagacatggatgcgaggaccactttggagactggggtggcctcaagagcacacagagaagggaagaaggggccatcacaggatgccacccctgccttgggttgggggcactctgccacgaccagccccttcctgggtatttattctctatttattggggataggagaagaggcatcctgcctgggtgggacagccccttgggccccttctcccctccccgcctggccagggagggccaccccactctacctccttagctttccctgtgccactttgactcagaggctgggagcatagcagaggccaggcccaggcagagctgacgggaggccccagctctgaggggagggggtccgtggtagagcctggggcaggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctttggaactaaaaaaaaaaaaaaaaaa

SEQ ID NO: 438 - protein, 753 aa, Homo sapiens [sequence omitted]

SEQ ID NO: 439 - DNA, 2133 bp, Homo sapiens
cgggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaatccaccaaccagaacgtggtttgcctgaggctgtaactgagagaaagattctggggctgtcttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctcccctttgttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaagtaatgacttagaaactgaaaaaaaaaaaaaaaaaaaaaaaaaaaaaa

SEQ ID NO: 440 - protein, 303 aa, Homo sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 441 - DNA, 373 bp, Homo sapiens
  modified_base (1)...(373): n = g, a, c or t
ctggcagaccctggcccaatcctaacagtgctaactcaattccatactcctcctcatcacctggctacctatgtgggaccccctggntggtggcggtcctccaggaacacccattatgcccagtcccgcagattcaacaaattccagtgacaacatctacacaatgattaatccagtgccgcctggaggcagccggtccaacttcccgatgggtcccggctcgaacggtccgatgggcggcatgggtggcatggagccacaccacatgaatggatcattagggtcaggcgacatagacggncttccaaaaaattctcctaacaacataagtggcattagcaatcctccaggcacccctcgagatgacggcgag

SEQ ID NO: 442 - DNA, 371 bp, Homo sapiens
ctcgccgtcatctcgaggggtgcctggaggattgctaatgccacttatgttgttaggagaattttttggaagtccgtctatgtcgcctgaccctaatgatccattcatgtggtgtggctccatgccacccatgccgcccatcggaccgttcgagccgggacccatcgggaagttggaccggctgcctccaggcggcactggattaatcattgtgtagatgttgtcactggaatttgttgaatctgcgggactgggcataatgggtgttcctggaggaccgccaccaccagggggtcccacataggtaccaggtgatgaggaggagtatggaattgagttagcactgttaggattgggccagggtctgccag

SEQ ID NO: 443 - DNA, 372 bp, Homo sapiens
ctggcagaccctggcccaatcctaacagtgctaactcaattccatactcctcctcatcacctggtacctatgtgggaccccctggctggtggcggtcctccaggaacacccattatgcccagtcccgcagattcaacaaattccagtgacaacatctacacaatgattaatccagtgccgcctggaggcagccggtccaacttcccgatgggtcccggctcgaacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgag

SEQ ID NO: 444 - DNA, 375 bp, Homo sapiens
  modified_base (1)...(375): n = g, a, c or t
ctcgncgatcatctcnaggggtgcctgtaaggatngcataagtgccacttatgttgtnaggagaattttttggaagtccgtctatgtcgcctgaccctaatgatccattcatgtggtgtggctccatgccacccatgccgcccatcggaccgttcgagccgggacccatcgggaagttggaccggctgcctccaggcggcactggattaatcattgtgtagatgttgtcactggaatttgttgaatctgcgggactgggcataatgggtgttcctggaggaccgccaccaccagggggtcccacataggtaccaggtgatgaggaggagtatggaattgagttagcactgttaggattgggccagggtctgccag

SEQ ID NO: 445 - DNA, 1561 bp, Homo sapiens
ccgcggccggggctgacgctttgacagctggaaagagcgcggagccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaaaaaaaaaaaaaaaaaaaaaaaaaaaaaa

SEQ ID NO: 446 - protein, 368 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 447 - DNA, 448 bp, Homo sapiens
ggagtcgtgggccgagaggaaccgggcccgggaagcgccgtcgtcgtcgtcgccggtcgcgttcccccggagaggcctgagaagctccgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggagccgcagaaccagcacagtggttagatgataagcggccgctcgactagttct

SEQ ID NO: 448 - DNA, 614 bp, Homo sapiens
  modified_base (1)...(614): n = g, a, c or t
gggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggagccgcanaaccagcacagtggttagatagataaagcggccgctcgactagtctgaggtctgatactcactgactgtcgtaagggcgaattccagcacactggcggccgttactagtggatccgagctcggtaccaagcttggcgtaatcatggtcatagctgtttcctgttgtgaaattgttatccgctcacaattccacacaaca

SEQ ID NO: 449 - DNA, 527 bp, Homo sapiens
atcactagtaacggccgccagtgtgctggaattcgcccttacgacagtcagtgagtatcagacctcagactagtcgagcggccgctttatctatctaaccactgtgctggttctgcggctccatctctcttagactctgatctagccaaagcttccagaaaagtaatctcccctgcgctaccgccgctcttgccggccgccatcttcctcctcccacgccgcctccttcttaatccatggcccacaccgccgccgtgctcgccgggatgaggggccgcgccggaggagggtagacgccgcagggttgcgggcctcgggctcagccgtcaggcgggctgcgctcccacgttcagacgggcctatacaaaggcaggccaggcgcgcccgggcctgtccgcgggctggcgggcagcgaggcccgcggcccgagcttctcaggcctctccgggggaacgcgaccggcgacgacgacgacggcgcttcccgggcccggttcctctcggcccacgactccccatccaccgccc

SEQ ID NO: 450 - DNA, 628 bp, Homo sapiens
  modified_base (1)...(628): n = g, a, c or t
gggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggagccgcagaaccagcacagtggttagatagataaagcggccgctcgactagtctgaggtctgatactcactgactgtcgaagggcgaattccagcacactggcggccgttactagtggatccgagctcggtaccaagcttggcgtaatcatggtcatagctgtttcctgtgtgaaattgtnatccgctcacaattccacacaacatacgagccggaagcat

SEQ ID NO: 451 - DNA, 529 bp, Homo sapiens
cggatcactagtaacggccgccagtgtgctggaattcgcccttcgacagtcagtgagtatcagacctcagactagtcgagcggccgctttatctatctaaccactgtgctggttctgcggctccatctctcttagactctgatctagccaaagcttccagaaaagtaatctcccctgcgctaccgccgctcttgccggccgccatcttcctcctcccacgccgcctccttcttaatccatggcccacaccgccgccgtgctcgccgggatgaggggccgcgccggaggagggtagacgccgcagggttgcgggcctcgggctcagccgtcaggcgggctgcgctcccacgttcagacgggcctatacaaaggcaggccaggcgcgcccgggcctgtccgcgggctggcgggcagcgaggcccgcggcccgagcttctcaggcctctccgggggaacgcgaccggcgacgacgacgacggcgcttcccgggcccggttcctctcggcccacgactccccatccaccgccc

SEQ ID NO: 452 - DNA, 575 bp, Homo sapiens
gggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggagccgcagaaccagcacagtggttagatagataaagcggccgctcgactagtctgaggtctgatactcactgactgtcgtaagggcgaattccagcacactggcggccgttactagtggatccgagctcggtaccaagcttggcgtaatcatggtcatagctgtttcc

SEQ ID NO: 453 - DNA, 533 bp, Homo sapiens
gctcggatcactagtaacggccgccagtgtgctggaattcgcccttacgacagtcagtgagtatcagacctcagactagtcgagcggccgctttatctatctaaccactgtgctggttctgcggctccatctctcttagactctgatctagccaaagcttccagaaaagtaatctcccctgcgctaccgccgctcttgccggccgccatcttcctcctcccacgccgcctccttcttaatccatggcccacaccgccgccgtgctcgccgggatgaggggccgcgccggaggagggtagacgccgcagggttgcgggcctcgggctcagccgtcaggcgggctgcgctcccacgttcagacgggcctatacaaaggcaggccaggcgcgcccgggcctgtccgcgggctggcgggcagcgaggcccgcggcccgagcttctcaggcctctccgggggaacgcgaccggcgacgacgacgacggcgcttcccgggcccggttcctctcggcccacgactccccatccaccgccc

SEQ ID NO: 454 - DNA, 594 bp, Homo sapiens
gggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaagctttggctagatcagagtctaagagagatggagccgcagaaccagcacagtggttagatagataaagcggccgctcgactagtctgaggtctgatactcactgactgtcgtaagggcgaattccagcacactggcggccgttactagtggatccgagctcggtaccaagcttggcgtaatcatggtcatagctgtttcctgtgtgaaattgttatccg

SEQ ID NO: 455 - DNA, 528 bp, Homo sapiens
gatcactagtaacggccgccagtgtgctggaattcgcccttacgacagtcagtgagtatcagacctcagactagtcgagcggccgctttatctatctaaccactgtgctggttctgcggctccatctctcttagactctgatctagccaaagcttccagaaaagtaatctcccctgcgctaccgccgctcttgccggccgccatcttcctcctcccacgccgcctccttcttaatccatggcccacaccgccgccgtgctcgccgggatgaggggccgcgccggaggagggtagacgccgcagggttgcgggcctcgggctcagccgtcaggcgggctgcgctcccacgttcagacgggcctatacaaaggcaggccaggcgcgcccgggcctgtccgcgggctggcgggcagcgaggcccgcggcccgagcttctcaggcctctccgggggaacgcgaccggcgacgacgacgacggcgcttcccgggcccggttcctctcggcccacgactccccatccaccgccc

SEQ ID NO: 456 - DNA, 4210 bp, Homo sapiens
atggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatatgcaaaatacgtcattatgttctggaactgtagttcatggtagacgttttcatcatgctcatgcacagataccagtagtaaaaacagcagcccaaagcagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaatcattttgtccagtgatgatgatgatgacaacgacagaactaacagaagagaaagcatatctcctcagcctgctgattcagcatgttcttcccctgcaccatccactggaaaagtagaagcagcactaaatgaaaatacttgcagagcagagcgtgaactacgaagcattccagaagactcagagttaaatacagttacattgccaagaaaagcaagaatgaaagaccagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattttttgtttagattttatcaagatacagctagacgaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaaatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtatcatttgaatctaaaatacaacttagaagcaaacaagaatttcagttttttgatgaagaagaagaaactggagaaaaccacaccatcttcattggcccagtagaaaagttgatagtatatccaccacctccagctaagggaggcatctctgttaccaatgaggacctgcactgtctaaatgaaggagaatttttaaatgatgttattatagacttttatttgaaatacttggtgcttgaaaaactgaagaaggaagacgctgaccgaattcatatattcagttcttttttctataaacgccttaatcagagagagaggagaaatcatgaaacaactaatctgtcaatacagcaaaaacggcatgggagagtaaaaacatggacccggcacgtagatatttttgagaaggattttatttttgtaccccttaatgaagctgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacagatggcttaagcaaaatcagactaaactatagcgatgaatcacctgaagctggtaaaatgcttgaagatgaactcgtcgacttctcagaagatcaggataaccaggatgatagcagtgacgatggattcctcgctgatgacaactgcagttcagaaataggacagtggcatttaaagcctactatctgtaaacaaccttgtatcctacttatggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatgtgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttat

SEQ ID NO: 457 - protein, 1112 aa, Homo sapiens
MAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENMQNTSLCSGTVVHGRRFHHAHAQIPVVKTAAQSSLDRKERKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQCVNSISD

SEQ ID NO: 458 - DNA, 756 bp, Homo sapiens
  modified_base (1)...(756): n = g, a, c or t
acaggaacacaaagactgcaaaggtaacatagaattgtgcagaagaagagtaatcgcctatgaggacgtaatctttccaatttacatcacatatgtttacacctggaggtggctgaaatgatgcctcattcaacctgaatggataaccaaaagtagctgtaacagttttattctcagtaactgcaggaggacaattcacttgaatttctgtttggcccttaaaacctccacaggtggcaaaagcaaagatagaagcaatccactcgaggaccttgatgaagccgagtggctccttgagcgggttgaggttgatctggaagccgccgcaggacccagcgcagtggttagatagataaagcgaccgctcgactagtctgaggtctgatactcactgactgtcgtaagggcgaattcgtttaaacctgcaggactagtccctttagtgagggttaattctgagcttggcgtaatcatggtcatagctgtttcctgtgtgaaattgttatccgctcacaattccacacaacatacgagccggaagcataaagtgtaaagcctggggtgcctaatgagtgagctaactcacattaatttgcgttgcgctcactggccgctttccagtcgggaaaaccttgtcgttgccagtgcattaatgaatcggccaacgccgcggggnagaggncggggtagcgtnaatagggggcggccccttacccggtttcctcccgctcanttgaatccgcttggccccgggcg

SEQ ID NO: 459 - DNA, 700 bp, Homo sapiens
  modified_base (1)...(700): n = g, a, c or t
acaggaacacaaagactgcaaaggtaacatagaattgtgcagaagaagagtaatcgcctatgaggacgtaatctttccaatttacatcacatatgtttacacctggaggtggctgaaatgatgcctcattcaacctgaatggataaccaaaagtagctgtaacagttttattctcagtaactgcaggaggacaattcacttgaatttctgtttggcccttaaaacctccacaggtggcaaaagcaaagatagaagcaatccactcgaggaccttgatgaagccgagtggctccttgagcgggttgaggttgatctggaagccgccgcaggacccagcgcagtggttagatagataaagcgaccgctcgactagtctgaggtctgatactcactgactgtcgtaagggcgaattcgtttaaacctgcaggactagtccctttantgagggttaattctgagcttggcgtaatcatggtcatagctgtttcctgtgtgaaattgttatccgctcacaattccacacaacatacgagccggaagcataaagtgtaaagcctggggtgccttaatgagttgagctaactcacatttaatttgcgtttgcgctcacttgggccgctttccaggttcggggaaaaactgtcgtgcccagttgcttaatgaatcgggcaacgcgcgggggagaggcggtgggtatng

SEQ ID NO: 460 - DNA, 445 bp, Homo sapiens
acaggaacacaaagactgcaaaggtaacatagaattgtgcagaagaagagtaatcgcctatgaggacgtaatctttccaatttacatcacatatgtttacacctggaggtggctgaaatgatgcctcattcaacctgaatggataaccaaaagtagctgtaacagttttattctcagtaactgcaggaggacaattcacttgaatttctgtttggcccttaaaacctccacaggtggcaaaagcaaagatagaagcaatccactcgaggaccttgatgaagccgagtggctccttgagcgggttgaggttgatctggaagccgccgcaggacccagcacagtggttagatagataaagcggccgctcgactagtctgaggtctgatactcactgactgtcgtaagggcgaattcgcggccgctaaattcaattcgccctatagtg

SEQ ID NO: 461 - DNA, 710 bp, Homo sapiens
  modified_base (1)...(710): n = g, a, c or t
acaggaacacaaagactgcaaaggtaacatagaattgtgcagaagaagagtaatcgcctatgaggacgtaatctttccaatttacatcacatatgtttacacctggaggtggctgaaatgatgcctcattcaacctgaatggataaccaaaagtagctgtaacagttttattctcagtaactgcaggaggacaattcacttgaatttctgtttggcccttaaaacctccacaggtggcaaaagcaaagatagaagcaatccactcgaggaccttgatgaagccgagtggctccttgagcgggttgaggttgatctggaagccgccgcaggacccagcacagtggttagatagataaagcggccgctcgactagtctgaggtctgatactcactgactgtcgtaagggcgaattcgcggccgctaaattcaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgaccgatcgcccttcccaacagttgcgcagcctatacgtacggcagtttaaggttttacnacctattaaaagagagagcccggtatcgtctgttgtggatgtncagagtgatatttatttggaaccccggggaaagaat

SEQ ID NO: 462 - DNA, 2130 bp, Homo sapiens
tgaaccgaggcaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatggattacacattttaaatgaacccataatttttttcactaaagctgtttgccctccaaagtgtttacacctaagcctaacatgtatcgctcattcagaaaactgttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgattttttttaattgcaaagactaggtgtatatttttttctgtttttctaaatgacccgtggtacttaataggtgtactaaaattgtgttgggagcagggatttggaaatttctgagagatgtgtagttaattagtaattctgtttcatgagatatgatctgttatgctagtggtttaataggcttgctatgtaagtagaacgtggctcaactagatatcttatatgtatgggcattacctcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcattttgcttcctaatctttttgttgtacagggattcaggtttcttattcttacaacatgattgtttatatgtgaagcacatcttgctgttgccttatttttgatgcttttattcatgacaagaattgtcaatataagaatgtatatctttgccgcaaccaatttaataaaggagttgaaagaaaaaaaaaaaaaaaaaaaaaa

SEQ ID NO: 463 - protein, 259 aa, Homo sapiens
MAPNIYLVRQRISRLGQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 464 - DNA, 165 bp, Homo sapiens
ccaatgtagttagtgcggatggcagggctggaaccattcaccacgttgttgtcaagggtgaggaggacactggtagagctggagcagcctttgttcctgaggatgtcttctggtgtggttccaaagacaaacctcacattctgcagcaccccctggaaaatgtca

SEQ ID NO: 465 - DNA, 166 bp, Homo sapiens
  modified_base (1)...(166): n = g, a, c or t
tgacattttccaggggggtgctgcagaatgtgaggtttgtctttggaaccacaccagaagacatcctcaggaacaaaggctgctccagctctaccagtgtnctcctcacccttgacaacaacgtggtgaatggttccagccctggcatccgnactaactacattgg

SEQ ID NO: 466 - DNA, 165 bp, Homo sapiens
tgacattttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattgg

SEQ ID NO: 467 - DNA, 160 bp, Homo sapiens
tgacattttccaggggtgctgcagaatgtgaggtttgtctttggaaccacaccagaagacatcctcaggaacaaaggctgctccagctctaccagtgtctcctcaccttgacaacaacgtggtgaatggttccagcctggcatccgactaactacattgg

SEQ ID NO: 468 - DNA, 164 bp, Homo sapiens
tgacattttccaggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattgg

SEQ ID NO: 469 - DNA, 165 bp, Homo sapiens
tgacattttccaggggtgctgcagaatgtgaggtttgtctttggaaccacaccagaagacatcctcaggaacaaaggctgctccagctctaccagtgtcctcctcacccttggacaacaacgtggtgaatggttccagccctgccatccgcactaactacattgg

SEQ ID NO: 470 - DNA, 165 bp, Homo sapiens; identical to SEQ ID NO: 466

SEQ ID NO: 471 - DNA, 164 bp, Homo sapiens; identical to SEQ ID NO: 468

SEQ ID NO: 472 - DNA, 165 bp, Homo sapiens; identical to SEQ ID NO: 469

SEQ ID NO: 473 - DNA, 165 bp, Homo sapiens; identical to SEQ ID NO: 469

SEQ ID NO: 474 - DNA, 104 bp, Homo sapiens
tgacattttccaggggtgctgcagaatgtgaggtttgtctttggaaccacaccagaagacatcctcaggaacaaaggctgtccagctctacagcgtcctcctca

SEQ ID NO: 475 - DNA, 162 bp, Homo sapiens
tgacatttcaggggtgctgcagaatgtgaggtttgtctttggaatcacaccagaagacatcctcaggaacaaaggctgctccagctctaccagtgtcctcctcacccttgacaacaacgtggtgaatggttccagccctgccatccgcactaactacattgg

SEQ ID NO: 476 - DNA, 165 bp, Homo sapiens
cgacattttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattgg

SEQ ID NO: 477 - DNA, 164 bp, Homo sapiens; identical to SEQ ID NO: 468

SEQ ID NO: 478 - DNA, 168 bp, Homo sapiens
  modified_base (1)...(168): n = g, a, c or t
gtgacattatccagtgggtgctgcagaatgtgaggtttgtctttggaaccacacncagaagacatcctcaggaacaaaggctgctccagctctaccagtgtcctcctcacccttgacaacaacgatggtgaatggttccagccctgncatccgcactaactacattgg

SEQ ID NO: 479 - DNA, 165 bp, Homo sapiens; identical to SEQ ID NO: 464

SEQ ID NO: 480 - DNA, 164 bp, Homo sapiens; identical to SEQ ID NO: 468

SEQ ID NO: 481 - DNA, 5722 bp, Homo sapiens
ggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaaaagatttaaacaggatggtggctggagccactggtccccgtggtcatcttgttctgtgacatgtggtgatggtgtgatcacaaggatccggctctgcaactctcccagcccccagatgaatgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccgcaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcatcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcaccttgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttccgtaattactaggtagttttctaattctctcttttggaagtatgatttttttaaagtctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattccttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagaatattcagattgtgtagatatgctatttaaataatttatcaggaaatactgcctgtagagttagtatttctatttttatataatgtttgcacactgaattgaagaattgttggttttttcttttttttgttttttttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatattt

SEQ ID NO: 482 - protein, 1170 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPAPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 483 - DNA, 87 bp, Homo sapiens
cactgtacccgaggggcaggccccagtaaagaagatcaggcctccaccatggccttcaagcagatggagcagatctctcagttcctg

SEQ ID NO: 484 - DNA, 1360 bp, Homo sapiens
gcccttgccttgagtcagtgcgctgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcagataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttg

SEQ ID NO: 485 - protein, 199 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 486 - DNA, 284 bp, Homo sapiens
ccgggcagcttcgcagttggctcgcttgcctgtgatgataatggtctctgaattgctattctctgctggaagggtcgattttggtgttgctttcttcacgaatctttttaatgtttgcgcctcctttcccaatgatattcttgtgaaactgtttgaagatcggaacagaaattgaatagctattttccaccagatctgccaccatcttctgcatgtattttgtgcatttttccacctcattcttaggtcctctgagctggacaatgtcacttttttgtgctggg

SEQ ID NO: 487 - DNA, 283 bp, Homo sapiens
cccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccgg

SEQ ID NO: 488 - DNA, 431 bp, Homo sapiens
cccaggacaaaaaagtgacattgtccagctcagaggacctaagaatgaggtggaaaaatgcacaaaatacatgcagaagatggtggcagatcgtggtggaaaatagctattcaatttgctgttccgattcttcaaacagtttcacaagaatatcattgggaaaggaggcgcaaacgattcaagaaagattcgtgaagaaagcaacaccaaaatcgaccttccagcagagaatagcaatttcagagaccattatcagtcacaggcaagcgagccaactgcgaagggttgccctggtccgctagaaacccagcacaggtggttagatggatacaagcggccgctcgactagtctgaggtctgatacttcactgactagtcgttaagggcgaattccagcacactggcggccgtcgactagtggatccgagctc

SEQ ID NO: 489 - DNA, 283 bp, Homo sapiens
ccgggcagcttcgcagttggctcgcttgcctgtgatgataatggtctctgaattgctattctctgctggaaggtcgattttggtgttgctttcttcacgaatctttttaatgtttgcgcctcctttcccaatgatattcttgtgaaactgtttgaagatcggaacagaaattgaatagctattttccaccagatctgccaccatcttctgcatgtattttgtgcatttttccacctcattcttaggtcctctgagctggacaatgtcacttttttgtgctggg

SEQ ID NO: 490 - DNA, 438 bp, Homo sapiens
cccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagttgcccggccgcagaaacccagcacagtggttagatagataaagcggccgctcgactagtctgaggtctgatactcactgactgtcgtaagggcgaattccagcacactggcggccgttactagtggatccgagctcggtaccaagcttggcgtaatcatggt

SEQ ID NO: 491 - DNA, 283 bp, Homo sapiens; identical to SEQ ID NO: 489

SEQ ID NO: 492 - DNA, 284 bp, Homo sapiens
cccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaagttcagagaccattatcatcacaggcaagcgagccaactgcgaagctgcccgg

SEQ ID NO: 493 - DNA, 4354 bp, Homo sapiens
gaattcggggggcgagtaagccagcggcaggaccagcgggcgggggccacaacaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccgaacccaaccacacaatggtttgtctcaatctgacccagcggctggaccctccgtaaattgttgagcgctcttccccttcccgaggtccgcagggagcctagcgcctggctgtgtgtgcggccgctcctccaggcctggccgtgcccgctcaggacctgctccactgtttaacaataaaccaaggtcatgagcattcgagctaagataacagactccagctcctggtccacccggcatgtcagtcagcactctggccttcatcacgagagctccgcagccgtggctaggattccacttcctgtgtcatgacctcaggaaataaacgtccttgactttataaaagccccgaattc

SEQ ID NO: 494 - protein, 1268 aa, Homo sapiens
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKKKKTTTIAVEVKKSQHKYVIGPKGNSLQEILERTGVSVEIPPSDSISETVILRGEPEKLGQALTEVYAKANSFTVSSVAAPSWLHRFIIGKKGQNLAKITQQMPKVHIEFTEGEDKITLEGPTEDVNVAQEQIEGMVKDLINRMDYVEINIDHKFHRHLIGKSGANINRIKDQYKVSVRIPPDSEKSNLIRIEGDPQGVQQAKRELLELASRMENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQIKFPDREENAVHSTEPVVQENGDEAGEGREAKDCDPGSPRRCDIIIISGRKEKCEAAKEALEALVPVTIEVEVPFDLHRYVIGQKGSGIRKMMDEFEVNIHVPAPELQSDIIAITGLAANLDRAKAGLLERVKELQAEQEDRALRSFKLSVTVDPKYHPKIIGRKGAVITQIRLEHDVNIQFPDKDDGNQPQDQITITGYEKNTEAARDAILRIVGELEQMVSEDVPLDHRVHARIIGARGKAIRKIMDEFKVDIRFPQSGAPDPNCVTVTGLPENVEEAIDHILNLEEEYLADVVDSEALQVYMKPPAHEEAKAPSRGFVVRDAPWTASSSEKAPDMSSSEEFPSFGAQVAPKTLPWGPKR

SEQ ID NO: 495 - DNA, 505 bp, Homo sapiens
gccgtccaggccatcgccaccctccgcagccatgtccaccaggtccgtgtcctcgtcctcctaccgcagatgttcggcggcccgggcaccgcgagccgggccgagctccagccggagctacgtgactacgtccacccgcacctacagcctgggcagcgcgctgcgccccagcaccagcgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacagaaggtggagctgcaggagctgaatgaccgcttcgccactatatcgacaggtgcgcttcctggagcagcagaataagatcctgctggccgagctcgagcagctcaagggccaaggcaagtcgcgcctgggggacctctacgaggaggagatgcgggagctgcgccggc

SEQ ID NO: 496 - DNA, 1851 bp, Homo sapiens
gggcgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctaggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacattcctgattaagacggttgaaactagagatggacaggttatcaacgaaacttctcagcatcacgatgaccttgaataaaaattgcacacactcagtggcaggcgatatattacccaggcaagaataaaaaagaaatcccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaactcca

SEQ ID NO: 497 - protein, 466 aa, Homo sapiens
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTFLIKTVETRDGQVINETSQHHDDLE

SEQ ID NO: 498 - DNA, 1839 bp, Homo sapiens
gccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 499 - protein, 466 aa, Homo sapiens
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 500 - DNA, 619 bp, Homo sapiens
  modified_base (1)...(619): n = g, a, c or t
accagtacaggccccagaacgaagacgagctggagctgcgtcgatggggtgacaggtgtggactgtcatgcatgcagtgtgacgactggctggtttgtgggtgtctcccggaggaccctagaaattcggaacgttccctgggaaattacgttgccccggtgtgagtcggtctccatggcaacttgagagccagccaggactggggctgggngagccgtgctggacaacttcgctagggaggagacgacgtgaaccacccgggccacattcctcctttcccgcagagaacncttgaacgctcccagtagtcttgccagaagcgggaacgcaccacggccagcccatatttcacgctcggagccncccacccaccttcgaaaggcccttccactggtaacattgacttctccaaccccctacggaaggctacaacaaggggccgattttccgctttctcccaacagcctcgccttgttgttccnatttttccccttgcctccccagacccgaaatttccccncgcgaaaaattacgagaggggtcttggcctatttgaaaggcnngggcaggnaccccaatttttcccagcgcccctgtnattttgagnaacccacggaaa

SEQ ID NO: 501 - DNA, 508 bp, Homo sapiens
  modified_base (1)...(508): n = g, a, c or t
accagtacaggccccagaacgaagacgagctggagctgcgcgagggggacagggtggatgtcatgcagcagtgcgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgccacatccccttcccaggacctgagctcccagcatctgcagacgaccccacggcagaccttttccctcgggaaccaccacacactcgaaagnccccctgggactgagttcccaaaccaggactcacagggcagttcccgtccgcaacgaggtcccgtttttcaactttgtccttcncccaacacaccgaacatcccccaagaagtaccagggaggtcctgcatnttggaagccgggagaacacnagtttatccaggggccgtataattngaggana

SEQ ID NO: 502 - DNA, 411 bp, Homo sapiens
  modified_base (1)...(411): n = g, a, c or t
accagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgccacatcctccttccccaggacctgagctcccagcatctgcagaaactgaaaaccccccgggcaagggccccttttcccccttcggggggaaccccncaccacatacaggnaaaganaacccatgngaacaggaaaacccaaaacgangaaaaaaaaagnggaatacaaccaaaaagaa

SEQ ID NO: 503 - DNA, 378 bp, Homo sapiens
  modified_base (1)...(378): n = g, a, c or t
accagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgccacatcctccttccccaggacctgagctcccagcatctgcagacganccccgcagcctttccctcggaccacacacactacgaaagnncacccacaggaccggagaaccaaacaaaagaaacgtcaacaggggcaagtatacacg

SEQ ID NO: 504 - DNA, 821 bp, Homo sapiens
  modified_base (1)...(821): n = g, a, c or t
cactatagggcgaattgggcctctagatgcatgctcgagcggccgccagtgtgatggatatctgcagaattcgcccttctctcggcatggacgagctgtacaaggaggaggccgccaaggccggtggcagcggtggctccagtgtgctgggttcttgcggcttggggtctggtctcaataaggcctggaaatggtctccgcttcaaagcagacctctgtatttggggagtggggtggggaggaaatgaaagggctgtgggaggaatgcctgtgagtcgtgggtgggaatcagtccagggggcttcgaggggggtccgagggaaaggctgcggggggtcgtactgcagatgctgggagctcaggtcctggggaaggaggatgttgggcgggggtcctctccctcccacgagtgccaccgtccccacccatcctggctggctccaagtttgccatggagaccactcacaccggggcaacgtaattttccagggaacgttccgaatttctgggtcctccgggagaacacccacaaaaccagcatcgttcacactgctgcaatgacatcacacctgtcccctcgcgcagctccaagctcgtacttacgttctggggcccttgtacttgggtccgggcagaaaccccagcacaaagatggggttaagaantaggaattaaaaaggcgcgggccggcatccgaaccataaanacatggaaaggggacctgaataacncaaacttggaactggatcngngacaaagggcggccgaaaatntatccccagcgnccaacaacnatggagacgggcccggtaccaaagatg

SEQ ID NO: 505 - DNA, 356 bp, Homo sapiens
  modified_base (1)...(356): n = g, a, c or t
accagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgaaccccgcagcctttccctcggaacctcgaagcggagaaaacaagaaaaaggaaaaaaggacccatantaanaataa

SEQ ID NO: 506 - DNA, 340 bp, Homo sapiens
  modified_base (1)...(340): n = g, a, c or t
cttggggtctggtctcaataaggcctggaaatggtctccgcttcaaagcagacctctgtatttggggagtggggtggggaggaaatgaaagggctgtgggaggaatgcctgtgagtcgtgggtgggaatcagtccagggggcttcgaggggggtccgagggaaaggctgcgggggtcgtctgcagatnctgggagctcaggtcctggggaaggaggatgtgggcgggggtcctctccctcccacgagtgccaccgtccccaccccatcctggctggctccaagttgccatggagaccactcacaccggggcaacgtaatttccagggaacgttccgaatt

SEQ ID NO: 507 - DNA, 341 bp, Homo sapiens
accagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccaccacgatc

SEQ ID NO: 508 - DNA, 311 bp, Homo sapiens
accagtacaggccccagaacgaagacgagctggagctgcgcgagggggacaggggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggaccctcgaa

SEQ ID NO: 509 - DNA, 455 bp, Homo sapiens
cttggggtctggtctcaataaggcctggaaatggtctccgcttcaaagcagacctctgtatttggggagtggggtggggaggaaatgaaagggctgtgggaggaatgcctgtgagtcgtgggtgggaatcagtccagggggcttcgaggggggtccgagggaaaggctgcgggggtcgtctgcagatgctgggagctcaggtcctggggaaggaggatgtgggcgggggtcctctccctcccacgagtgccaccgctccccaccccatcctggctggctccaagttgccatggagaccactcacaccggggcaacgtaatttccagggaacgttccgaatttctgggtcctccgggagacacccacaaaccagccatcgtcacactgctgcatgacatccaccctgtccccctcgcgcagctccagctcgtcttcgttctggggcctgtactggt

SEQ ID NO: 510 - DNA, 250 bp, Homo sapiens
cttggggtctggtctcaataaggcctggaaatggtctccgcttcaaagcagacctctgtatttggggagtggggtggggaggaaatgaaagggctgtgggaggaatgcctgtgagtcgtgggtgggaatcagtccagggggcttcgaggggggtccgagggaaaggctgcgggggtcgtctgcagatgctgggagctcaggtcctggggaaggaggatgtgggcgggggtcctctccctcccacgagtgc

SEQ ID NO: 511 - DNA, 384 bp, Homo sapiens
cttggggtctggtctcaataaggcctggaaatggtctccgcttcaaagcagacctctgtatttggggagtggggtggggaggaaatgaaagggctgtgggaggaatgcctgtgagtcgtgggtgggaatcagtccagggggcttcgaggggggtccgagggaaaggctgcgggggtcgtctgcagatgctgggagctcaggtcctggggaaggaggatgtgggcgggggtcctctccctcccacgagtgccaccgtccccaccccatcctggctggctccaagttgccatggagaccactcacaccggggcaacgtaatttccagggaacgttccgaatttctgggtcctccgggagacacccacaaaccagccatcgtcacac

SEQ ID NO: 512 - DNA, 400 bp, Homo sapiens
cttggggtctggtctcaataaggcctggaaatggtctccgcttcaaagcagacctctgtatttggggagtggggtggggaggaaatgaaagggctgtgggaggaatgcctgtgagtcgtgggtgggaatcagtccagggggcttcgaggggggtccgagggaaaggctgcgggggtcgtctgcagatgctgggagctcagtcctggggaaggaggatgtgggcgggggtcctctccctcccacagtgccacgtccccccacccatccctgggcgtggctccaagttgccagtggaagaacactcaccacccggggccaaccggtaatttccaagggaaccggttcccgaaatttcctggggtccctccgggaaaaaaccaacaaaacaagccctacggca

SEQ ID NO: 513 - DNA, 453 bp, Homo sapiens
cttggggtctggtctcaataaggcctggaaatggtctccgcttcaaagcagacctctgtatttggggagtggggtggggaggaaatgaaagggctgtgggaggaatgcctgtgagtcgtgggtgggaatcagtccagggggcttcgaggggggtccgagggaaaggctgcgggggtcgtctgcagatgctgggagctcagtcctggggaaggaggatgtgggcgggggtcctctccctcccacgagtgccaccgctccccaccccatcctggctggctccaagttgccatggagaccactcacaccggggcaacgtaatttccagggaacgttccgaatttctgggtcctccgggagacacccacaaaccagccatcgtcacactgctgcatgacatccaccctgtccccctcgcgcagctccgctcgtcttcgttctggggcctgtactggt

SEQ ID NO: 514 - DNA, 597 bp, Homo sapiens
cttggggtctggtctcaataaggcctggaaatggtctccgcttcaaagcagacctctgtatttggggagtggggtggggaggaaatgaaagggctgtgggaggaatgcctgtgagtcgtgggtgggaatcagtccagggggcttcgaggggggtccgagggaaaggctgcgggggtcgtctgcagatgctgggagctcaggtcctggggaaggaggatgtgggcgggggtcctctccctcccacgagtgccaccgtccccacccatcctggctggctccaagttgccatggagaccactcacaccggggcaacgtaatttccagggaacgttccgaatttctgggtcctccgggagacacccacaaaccagccatcgtcacactgctgcatgacatccaccctgtccccctcgcgcagctccagctcgtcttcgttctggggcctgtactggtccgcagaaaacccagcacagtggttagatacgataaagcggaccgctcgactagtctgaggtctgatactcaactggactgtcgtaatggggcgaattcttggcaagattttccatcacacttgcggggcgtcgaagcatgcat

SEQ ID NO: 515 - DNA, 302 bp, Homo sapiens
accagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgccacattctcctttccccaggacctgagctcccagcatctgcagacgaaccccggaagctttccctcgga

SEQ ID NO: 516 - DNA, 465 bp, Homo sapiens
  modified_base (1)...(465): n = g, a, c or t
cttggggtctggtctcaataaggcctggaaatggtctccgctttcaaagcagacctcttgtatttggggagtggggtggaggaggaaatgaaagggctgtgggaggaatgcctgttgagatcggtgggtgggaatcagtccagggggcttcgaggggggtccgagggaaaggctgcgggggtcgtctgcagatcctgggagcctcaggtcctggggaaggaggatgtgggcgggggtcctctccctcccacgagtgccaccggtccccaccccatcctggctggctccaagttgccatggagaccactcacaccggggcaacgtaatttccagggaacgttccgaatttctgggtcctccgggagaacacccacaaaccagccatcgtcacactgctgcatgacatccaccctgtccccctcgcgcagctcccagctcgtctccgtnctggggcctgtactggtc

SEQ ID NO: 517 - DNA, 458 bp, Homo sapiens
cttggggtctggtctcaataaggcctggaaatggtctccgcttcaaagcagacctctgtatttggggagtggggtggggaggaaatgaaagggctgtgggaggaatgcctgtgagtcgtgggtgggaatcagtccagggggcttcgaggggggtccgagggaaaggctgcgggggtcgtctgcagatgcttgggagctcaggtcctggggaagggggatgtgggcgggggtcctctccctcccacgagtgccaccgtccccaacccatcctggctggctccaagttgccatggagaccactcacaccggggcaacgtaatttccagggaacgttccgaatttctgggtcctccgggagacacccacaaaccagccatcgtcgcactgctgcatgacatccaccctgttcccctcgcgcagttccagctcgtcttacgttctggggcctgtaactgggt

SEQ ID NO: 518 - DNA, 529 bp, Homo sapiens
gcttggggtctggtctcaataaggcctggaaatggtctccgcttcaaagcagacctctgtatttggggagtggggtggggaggaaatgaaagggctgtgggaggaatgcctgtgagtcgtgggtgggaatcagtccagggggcttcgaggggggtccgagggaaaggctgcgggggtcgtctgcagatgctgggagctcagtcctggggaaggaggatgtgggcgggggtcctctccctcccacgagtgccaccgctccccaccccatcctggctggctccagttgccatgaaccactcacaccggggcaacgtaatttccagggaacgttccgaatttctgggtcctccgggagacacccacaaaccagccatcgtcacactgctgcatgacatccaccctgtccccctcgcgcagctccgctcgtcttcgttctggggcctgtactggtccgcaaacccagcacagtggttagatgattaagcggccgctcgactagtctgaggtctgatactcactgactttttaa

SEQ ID NO: 519 - DNA, 2938 bp, Homo sapiens
cggacgcgtgggcaggcagcagccgggcagggatgctcctgcgctcccgggcggcctcgggcccagccacctgctcgccggggaagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcatttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaagggccttcgtggcctcga

SEQ ID NO: 520 - protein, 671 aa, Homo sapiens
MQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 521 - protein, 200 aa, Artificial Sequence
  poly Gly flexible linker
  MOD_RES (6)...(200): Gly at positions 6-200 may be present or absent
GGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGG

SEQ ID NO: 522 - protein, 6 aa, Artificial Sequence
  linker (GGS)-2 in plakoglobin-GFP fusion protein construct
GGSGGS

What is claimed is:

1. A method for identifying a compound that modulates angiogenesis, the method comprising the steps of:
   (i) contacting the compound with a Δ-5 fatty acid desaturase (FADSD5) polypeptide encoded by a nucleic acid, wherein the nucleic acid has at least 95% identity to the nucleotide sequence of SEQ ID NO:68 and wherein the FADSD5 polypeptide regulates cell surface expression of an αvβ3 protein in an endothelial cell;
   (ii) determining the effect of the compound upon an in vitro activity of the FADSD5 polypeptide, wherein the compound is capable of binding to FADSD5;
   (iii) further determining the effect of the compound identified in step (ii) upon a cell-based angiogenesis assay using an endothelial cell that expresses the FADSD5 polypeptide; and
   (iv) identifying a compound that modulates the activity of the FADSD5 polypeptide, wherein the modulation of the FADSD5 polypeptide regulates cell surface αvβ3 protein expression, and wherein the regulation of αvβ3 protein expression indicates angiogenesis is modified, thereby identifying a compound that modulates angiogenesis.

2. The method of claim 1, wherein the in vitro activity is fatty acid desaturase activity.

3. The method of claim 1, wherein the in vitro activity is arachadonic acid synthesis.

4. The method of claim 1, wherein the in vitro activity is heme or fatty acid binding to the FADSD5 polypeptide.

5. The method of claim 1, wherein the cell-based angiogenesis assay is αvβ3 expression.

6. The method of claim 1, wherein the cell-based angiogenesis assay is a member selected from αvβ3 expression, haptotaxis, and chemotaxis.

7. The method of claim 1, wherein modulation is inhibition of angiogenesis.

8. The method of claim 1 wherein the FADSD5 polypeptide is recombinant.

9. The method of claim 1, wherein the Δ-5 fatty acid desaturase (FADSD5)polypeptide is encoded by a nucleic acid comprising the nucleotide sequence of SEQ ID NO:68.

10. The method of claim 1, wherein the FADSD5 polypeptide comprises a sequence of SEQ ID NO:69.

11. The method of claim 1, wherein the compound is an antibody.

12. The method of claim 1, wherein the compound is an antisense molecule.

13. The method of claim 1, wherein the compound is a small organic molecule.

14. The method of claim 1, wherein the compound is a peptide.

15. A method for identifying a compound that modulates angiogenesis, the method comprising the steps of:
   (i) contacting the compound with an endothelial cell that expresses a Δ-5 fatty acid desaturase (FADSD5) polypeptide encoded by a nucleic acid, wherein the nucleic acid has at least 95% identity to the nucleotide sequence of SEQ ID NO:68 and wherein the FADSD5 polypeptide regulates cell surface expression of an αvβ3 protein in an endothelial cell;

(ii) determining the effect of the compound upon a cell-based angiogenesis assay using the endothelial cell that expresses the FADSD5 polypeptide, wherein the compound is capable of binding to FADSD5; and (iii) identifying a compound that modulates the activity of the FADSD5 polypeptide, wherein the modulation of the FADSD5 polypeptide regulates cell surface αvβ3 protein expression, and wherein the regulation of αvβ3 protein expression indicates angiogenesis is modified, thereby identifying a compound that modulates angiogenesis.

16. The method of claim 1 or claim 15, wherein the FADSD5 polypeptide is encoded by SEQ ID NO:68.

17. The method of claim 15, wherein modulation is inhibition of angiogenesis.

18. A method for identifying a compound that modulates expression of an αvβ3 protein in an endothelial cell, the method comprising the steps of:

(i) contacting the compound with an endothelial cell that comprises a Δ-5 fatty acid desaturase (FADSD5) polypeptide encoded by a nucleic acid with at least 95% identity to the nucleotide sequence of SEQ ID NO:68, wherein the FADSD5 polypeptide regulates cell surface expression of an αvβ3 protein in the endothelial cell; and (ii) determining the effect of the compound upon the expression of the αvβ3 protein in the endothelial cell, wherein the FADSD5 polypeptide contacted by the compound regulates cell surface expression of an αvβ3 protein in the endothelial cell, thereby identifying a compound that modulates expression of an αvβ3 protein in an endothelial cell.

* * * * *